US011578109B2

(12) United States Patent
Nicosia et al.

(10) Patent No.: US 11,578,109 B2
(45) Date of Patent: Feb. 14, 2023

(54) UNIVERSAL VACCINE BASED ON SHARED TUMOR NEOANTIGENS FOR PREVENTION AND TREATMENT OF MICRO SATELLITE INSTABLE (MSI) CANCERS

(71) Applicant: NOUSCOM AG, Basel (CH)

(72) Inventors: Alfredo Nicosia, Naples (IT); Elisa Scarselli, Rome (IT); Guido Leoni, Rome (IT); Armin Lahm, Rom (IT)

(73) Assignee: NOUSCOM AG, Basel (CH)

( * ) Notice: Subject to any disclaimer, the term of this patent is extended or adjusted under 35 U.S.C. 154(b) by 337 days.

(21) Appl. No.: 16/626,458

(22) PCT Filed: Jul. 12, 2018

(86) PCT No.: PCT/EP2018/069032
§ 371 (c)(1),
(2) Date: Dec. 24, 2019

(87) PCT Pub. No.: WO2019/012082
PCT Pub. Date: Jan. 17, 2019

(65) Prior Publication Data
US 2020/0222519 A1    Jul. 16, 2020

(30) Foreign Application Priority Data
Jul. 12, 2017 (EP) .................................... 17181026

(51) Int. Cl.
| A61K 38/00 | (2006.01) |
| A61P 35/00 | (2006.01) |
| A61K 38/16 | (2006.01) |
| A61K 38/10 | (2006.01) |
| A61K 38/08 | (2019.01) |
| C07K 5/00 | (2006.01) |
| C07K 7/00 | (2006.01) |
| C07K 16/00 | (2006.01) |
| C07K 17/00 | (2006.01) |
| A61K 38/04 | (2006.01) |
| C07K 14/47 | (2006.01) |
| G16B 20/00 | (2019.01) |
| A61K 39/00 | (2006.01) |
| C12N 15/00 | (2006.01) |

(52) U.S. Cl.
CPC .......... *C07K 14/4748* (2013.01); *A61K 38/04* (2013.01); *A61K 38/08* (2013.01); *A61K 38/10* (2013.01); *A61K 38/16* (2013.01); *A61K 39/0011* (2013.01); *C07K 7/00* (2013.01); *C12N 15/00* (2013.01); *G16B 20/00* (2019.02); *A61K 2039/5152* (2013.01)

(58) Field of Classification Search
None
See application file for complete search history.

(56) References Cited

U.S. PATENT DOCUMENTS 9,205,140 B2 * 12/2015 Kloor ................. A61K 39/0011
2014/0235456 A1 * 8/2014 Garner, Jr. ............. G16B 35/00
702/19

FOREIGN PATENT DOCUMENTS

| WO | 2010/136598 A1 | 12/2010 |
| WO | 2016/187508 | 11/2016 |
| WO | 2017/020026 A1 | 2/2017 |

OTHER PUBLICATIONS

Halbroth et al., Scientific Rep. 8:14 pages (2018) (Year: 2018).*
Freisewinkel et al., Proc. Natl. Acad. Sci. USA 90:9703-9706 (1993) (Year: 1993).*
Starodubova et al., Acta Nat. 2:53-59 (2010) (Year: 2010).*
Kou et al., Immunol. Lett. 190:51-57 (2017) (Year: 2017).*
De Sousa Linhares et al., Frontiers Immunol. 9:15 pages (2018) (Year: 2018).*
Kim et al., Cell 155:858-868 (2013) (Year: 2013).*
The International Search Report (ISR) with Written Opinion for PCT/EP2018/069032 dated Oct. 30, 2018, pp. 1-16.
Schwitalle, Yvette et al. "Immunogenic peptides generated by frameshift mutations in DNA mismatch repair-deficient cancer cell" Cancer Immunity (2004) vol. 4, pp. 1-10.
Woerner, Stefan M. et al. "Systematic identification of genes with coding microsatellites mutated in DNA mismatch repair-deficient cancer cells" International Journal of Cancer (2001) vol. 93, pp. 12-19.
Luhui, Shen et al. "Abstract 469: Progress towards developing a universal, prophylactic cancer vaccine." Cancer Research (2013) vol. 73(8), 2 pages.
Office Action in Russian Patent Application No. 2019144505, dated Oct. 8, 2021 (with Translation).
Office Action for JP2020-501311, dated Jun. 2022 (with English Translation).

* cited by examiner

*Primary Examiner* — Thea D' Ambrosio
(74) *Attorney, Agent, or Firm* — McDonnell Boehnen Hulbert & Berghoff, LLP

(57) ABSTRACT

This invention relates to a method of selecting a collection of frame-shift peptides (CFSPs) to produce a universal cancer vaccine peptide collection (CVP) for prophylaxis and treatment of patients with hereditary and sporadic microsatellite instability (MSI) tumors. This invention relates as well to a method of producing a CVP by selecting a subset of frame-shift peptides (FSPs) from the CFSP and optionally modifying the FSP's amino acid (aa) sequence to generate modified FSPs (mFSPs). The invention further relates to nucleic acid collections encoding a CVP of FSPs and/or mFSPs in one or more vaccine vectors that can be used also simultaneously. These CVPs, nucleic acids and vectors are used for the prophylaxis or treatment of MSI cancers.

8 Claims, 8 Drawing Sheets

Figure 1:
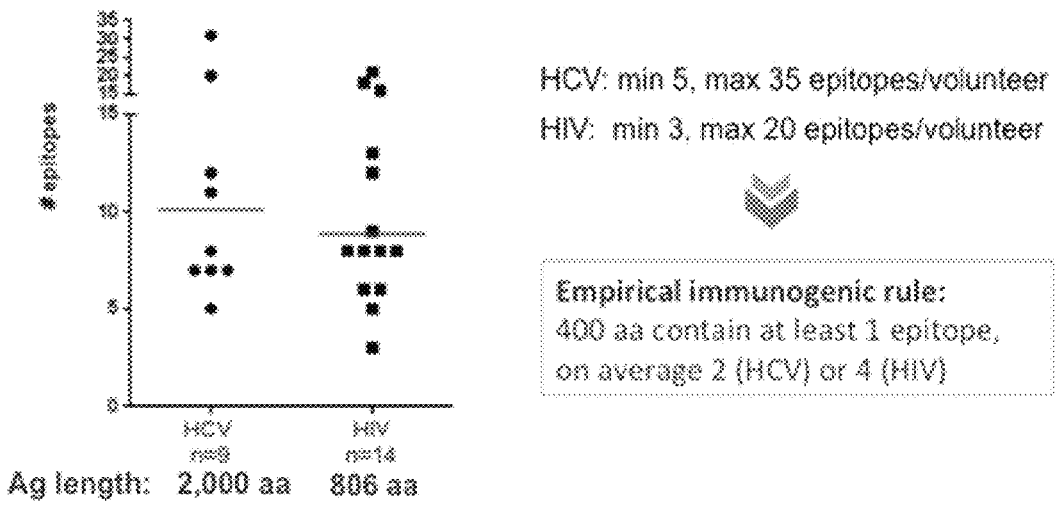

Specification includes a Sequence Listing.

UNIVERSAL VACCINE BASED ON SHARED TUMOR NEOANTIGENS FOR PREVENTION AND TREATMENT OF MICRO SATELLITE INSTABLE (MSI) CANCERS

CROSS-REFERENCE TO RELATED APPLICATION

This application is a U.S. national phase of International Application No. PCT/EP2018/069032, filed on Jul. 12, 2018, which claims priority to European Patent Application No. 17181026.0, filed Jul. 12, 2017, both of which are incorporated by reference herein in their entirety.

This invention relates to a method of selecting a collection of frame-shift peptides (CFSPs) to produce a universal cancer vaccine peptide collection (CVP) for prophylaxis and treatment of patients with hereditary and sporadic microsatellite instability (MSI) tumors. This invention relates as well to a method of producing a CVP by selecting a subset of frame-shift peptides (FSPs) from the CFSP and optionally modifying the FSP's amino acid (aa) sequence to generate modified FSPs (mFSPs). The invention further relates to nucleic acid collections encoding a CVP of FSPs and/or mFSPs in one or more vaccine vectors that can be used also simultaneously. These CVPs, nucleic acids and vectors are used for the prophylaxis or treatment of MSI cancers.

SEQUENCE LISTING STATEMENT A computer readable form of the Sequence Listing is filed with this application by electronic submission and is incorporated into this application by reference in its entirety. The Sequence Listing is contained in the file created on Aug. 23, 2022 having the file name "19-2369-PCT-US_ST25.txt" and is 1,634 kb in size.

BACKGROUND OF THE INVENTION

The field of cancer vaccines has focused for a long time on targeting tumor-associated and, more recently, tumor-specific antigens. The latter can arise in cancer cells from oncogenic viral proteins or somatic mutations in coding genes leading to the production of tumor neoantigens, defined as such because not present in normal cells. While being more appealing for the lower risk of self-tolerance and autoimmunity, tumor neoantigens vary significantly among the cancerous cells of a given patient and across the human population, hampering the development of an effective universal cancer vaccine based on shared tumor neoantigens.

There is however a group of cancers that does not follow this general rule due to its underlying biology: microsatellite instable (MSI) tumors frequently caused by mutations in DNA mismatch repair genes (MMR). A defective MMR system leads to accumulation of mutations in regions of repetitive nucleotide sequences called microsatellites. Mutations at microsatellites of coding genes can lead to a shift of the translational reading frame resulting in chimeric proteins whose C-terminus is composed of a novel non-self peptide, a so-called frame shift peptide (FSP). Unlike most cancers, mutations in MSI tumors arise preferentially in microsatellites consisting of mononucleotide repeats (MNRs). Within coding regions, such mutations mostly consist of a 1 nucleotide deletion and affect a limited number of genes, being therefore shared among patients (Kim, T. M., et al. (2013) Cell 155(4): 858-868).

Hence, MSI-associated cancers offer a unique opportunity to design a universal vaccine based on shared tumor neoantigens. MSI-tumors include both sporadic and inherited cancers. MSI-tumors include both sporadic and inherited cancers caused by somatic and germline mutations in MMR genes, respectively. The Lynch syndrome (LS) is a rare disease (ORPHA144) that falls in the second group. In particular, individuals with heterozygous germline mutations in either MSH2 or MLH1 genes of the MMR pathway (~90% of genetic LS carriers) are at higher risk for cancer development. Specifically, they are predisposed to develop colon or endometrial cancer in >50% of cases during their lifespan (Boland, C. R. and A. Goel (2010) Gastroenterology 138(6): p. 2073-2087 e3).

In summary, the invention described here relates to the identification of shared FSP neoantigens across MSI tumors and to the development of a universal vaccine based on a subset of FSPs and modified FSPs (defined as CVP) derived from a CFSP for treatment of MSI cancers and for their prevention, particularly in LS carriers. These CVP may provide inter alia the following advantages: (i) good therapeutic and/or prophylactic immune responses for a large variety of MSI cancers; (ii) an off-the-shelf vaccine that is ready to use and effective in a large cohort of patients because it encodes a large set of shared FSPs; (iii) a particular CVP can be selected in such a way to be suitable for treatment and prophylaxis of any MSI cancer, this is particularly useful in a prophylactic setting; (iv) no risk of autoimmune responses due to the exclusion of potential self-epitopes.

To the best knowledge of the inventors, the methods of the invention are characterized by various features unknown before, including:

(i) A variety of safeguards, such as
  a) selecting frameshift peptides from a gene which is, on average, expressed above a threshold in the selected tumor type,
  b) selecting frameshift peptides that are absent or very rare in tissue of healthy subjects,
  c) excluding segments from frameshift peptides which are identical to segments with length 8 amino acids or more in normal human proteins, and
  c) using a large number of cancer samples.
(ii) The inclusion of frameshift peptides with a length shorter than that of a minimal putative CD8+ T cell epitope (8mer). This is achieved by the addition of up to 4 wildtype amino acids to generate a peptide of at least 8 amino acids.
(iii) The selection of an optimal collection of frameshift peptides to be included in the vaccine such that each individual cancer sample (cancer samples represent the population targeted by the vaccine) contains a portion of the frameshift peptides encoded by the vaccine and the total length of the frameshift peptides represented in this portion is at least 400 amino acids. Clinical trials on vaccines targeting viral antigens have shown that, on average, 400 amino acid of viral antigen, i.e. non-self antigens just like frameshift peptides, is needed to generate at least 1 immunogenic T cell response in each patient. Although for each cancer sample the portion of frameshift peptides covered will be different (i.e. each cancer sample contains a different subset of frameshift mutations and, consequently, a different subset of frameshift peptides out of the optimal collection will be present), the optimal collection is selected in such a way that the fraction of frameshift peptides covered in each tumor sample will have a total length of at least 400 amino acids. Incorporating this 400 amino acid rule into the disclosed selection method thus ensures induction of T cells agaist FSP present in tumors of the vaccine target population.

SUMMARY OF THE INVENTION

In a first aspect, the present invention relates to a method of selecting a collection of frame-shift peptides (CFSP) for producing a universal micro-satellite instability (MSI) cancer vaccine peptide collection (CVP) for prophylaxis or treatment of a patient with a cancer comprising hereditary and sporadic MSI cancer or being at risk of developing such a cancer, comprising the steps of:
(i) selecting a collection of nucleic acids (CFSM), each comprising a frame-shift mutation (FSM), each FSM being present in one or more of at least M cancer samples (CS), each of a different patient, wherein the cancer of the patient comprises cancer cells with an MSI phenotype; wherein at least 50% of the FSM that are selected fulfill criteria (a), (b), (c) and/or (d):
  (a) the FSM is present in a mononucleotide repeat (MNR) of coding genes with a length equal to or longer than 6 nucleotides;
  (b) the FSM corresponds to a deletion of 1 nucleotide;
  (c) the number of DNA sequencing reads harboring the FSM is significantly higher in the tumor sample as compared to the matched normal sample (FDR-corrected Fisher test p-value equal to or lower than 0.05);
  (d) the FSM is present in the matched normal samples with an allele frequency lower than 25%,
(ii) selecting X different frame-shift peptides (FSPs), wherein each selected FSP is the complete translation product of the protein-encoding segment of a nucleic acid comprising a FSM of the CFSM of at least 4 amino acid length, starting from the codon encoding the first amino acid that is different relative to the translation product of the corresponding wild type (wt) nucleic acid without the FSM,
wherein X is at least 20 more preferably at least 35 and M is at least 5.

In a second aspect, the present invention relates to a method of determining the amino acid sequences of peptides comprised in a CVP or of the nucleic acid sequences encoding the peptides comprised in the CVP, comprising the steps of:
(a) selecting at least Y FSPs or at least 8 amino acid long fragments thereof from the CFSP selected according to the first aspect of the invention;
(b) modifying the amino acid sequence of one or more or of all of those FSPs which fulfill the following criteria: (i) the FSP has a length of between 4 to 9 amino acids, and/or (ii) the FSP contains one or more identical contiguous stretches of 8 or more amino acids present in more than one FSP encoded by the same FSM and/or (iii) the FSP contains one or more contiguous stretches of 8 or more amino acids also present in wt human proteins,
wherein the amino acid sequence of an FSP according to (i) is modified by adding to the N-terminus of the FSP between 1 to 4 amino acids of the wild type (wt) amino acid sequence present immediately upstream of the FSP and wherein the modified FSP (mFSP) has a length of at least 8 amino acids; the amino acid sequence of a FSP according to (ii) is modified by removing these contiguous stretches from all but the longest FSP with the proviso that FSPs with a length of less than 4 amino acids after removal of the contiguous stretch are excluded from the CVP; and/or the amino acid sequence of a FSP according to (iii) is modified by removing these stretches; modified FSPs with a length of less than 4 amino acids after removal of the contiguous stretch are excluded from the CVP, and
wherein the amino acid sequences of the CVP comprises the amino acid sequences of the FSPs or fragments thereof selected in step a) and/or modified in step (b);
and wherein Y is at least 20 more preferably at least 35

In a third aspect, the present invention relates to a method of producing a CVP or a collection of nucleic acids encoding the CVP comprising the steps of
(i) obtaining the amino acid or nucleic acid sequence information determined in the method of the second aspect of the invention; and
(ii) synthesizing the amino acid sequence of the CVP in one or more polypeptides or a collection of nucleic acids with that sequence and optionally inserting the collection of nucleic acids into one or more expression cassettes and/or a collection of expression vectors.

In a fourth aspect, the present invention relates to a CVP or a collection of nucleic acids encoding the peptides of said CVP producible by the method of the third aspect of the invention.

In a fifth aspect, the CVP comprising or consisting of Y different FSPs and/or mFSPs, wherein each FSP or the FSP which is modified to mFSP is a fragment of or the complete translation product of the protein-encoding segment of a FSM containing nucleic acid starting from the codon encoding the first amino acid that is different relative to the translation of the corresponding wt nucleic acid without the FSM of in either case at least 4 amino acid length and wherein at least 50% of the FSPs or the FSPs which are modified to mFSPs fulfill one or more of the following criteria:
(a) the FSP is encoded by a FSM that is observed with a cancer type-specific frequency (CF) observed for a subset of CS of a specific type of cancer that are part of a collection of M different CS that is at least 5% for at least one of the cancer types present in the CS; and/or
(b) the average mRNA expression level of the gene with the FSM encoding the FSP is in the top $80^{th}$ percentile of the distribution describing the average mRNA expression values of each protein-encoding gene across the CS; and/or
(c) the FSM generating the FSP is observed in less than 2% in normal tissues in a cohort of subjects without a cancer
wherein the amino acid sequence of one or more or all those FSPs which fulfill the following criteria: (i) the FSP has a length of between 4 to 9 amino acids, and/or (ii) the FSP contains one or more identical contiguous stretches of 8 or more amino acids present in more than one FSP encoded by the same FSM and/or (iii) the FSP contains one or more contiguous stretches of 8 or more amino acids also present in wt human proteins,
is modified for a FSP according to (i) by adding to the N-terminus of the FSP between 1 to 4 amino acids of the wild type (wt) amino acid sequence present immediately upstream of the FSP and wherein the modified FSP (mFSP) has a length of at least 8 amino acids; for a FSP according to (ii) is modified by removing these contiguous stretches from all but the longest FSP with the proviso that FSPs with a length of less than 4 amino acids after removal of the contiguous stretch are excluded from the CVP; and/or for a FSP according to (iii) is modified by removing these stretches; modified FSPs with a length of less than 4 amino acids after removal of the contiguous stretch are excluded from the CVP;
and wherein Y is at least 20 and more preferably at least 35 and M is at least 5.

In a sixth aspect, the present invention relates to a nucleic acid collection encoding the CVP of the fifth aspect of the present invention.

In a seventh aspect, the present invention relates to a collection of one or more expression vectors, each comprising all or part of the nucleic acid collection of the fourth or sixth aspect of the present invention, wherein the entirety of the collection of expression vectors comprise all of the nucleic acid collection of the fourth or sixth aspect of the present invention.

In an eighth aspect, the present invention relates to a CVP of the fourth or fifth aspect of the present invention, a nucleic acid collection of the fourth or sixth aspect of the present invention, an expression vector collection of the seventh aspect of the present invention, for use in prophylaxis or treatment of a patient with a cancer comprising cancer cells with an MSI phenotype or being at risk of developing such cancer, wherein the cancer is preferably selected from the group consisting of colorectal cancer, gastric cancer, endometrial cancer, small intestine cancer, hepatobiliary tract cancer, liver cancer, neuroendocrine cancers, cervical cancer, ovarian cancer, uterine sarcomas, brain cancer and skin cancer In an eight aspect, the present invention relates to a nucleic acid collection of the fourth or sixth aspect of the present invention and/or a expression vector collection of the seventh aspect of the present invention for use in prophylaxis or treatment of a patient with a cancer comprising cancer cells with an MSI phenotype or being at risk of developing such cancer, wherein the nucleic acid collection and/or the expression vector collection is administered in a heterologous prime-boost vaccination scheme, preferably the prime is with an adenovirus vector and one or more boosts are with an MVA vector.

FIGURE LEGENDS

FIG. 1: Antigen length determines the number of vaccine-induced immunogenic epitopes.

Figure 2:
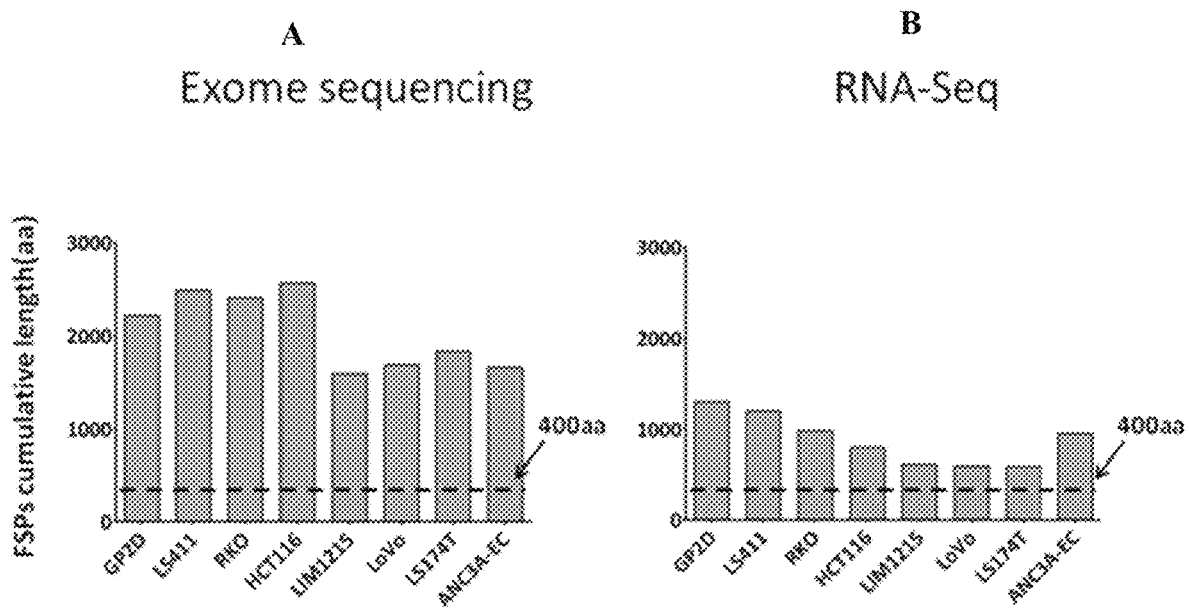

FIG. 2: Immunogenic coverage of Nous-209 in MSI cell lines.

Figure 3:
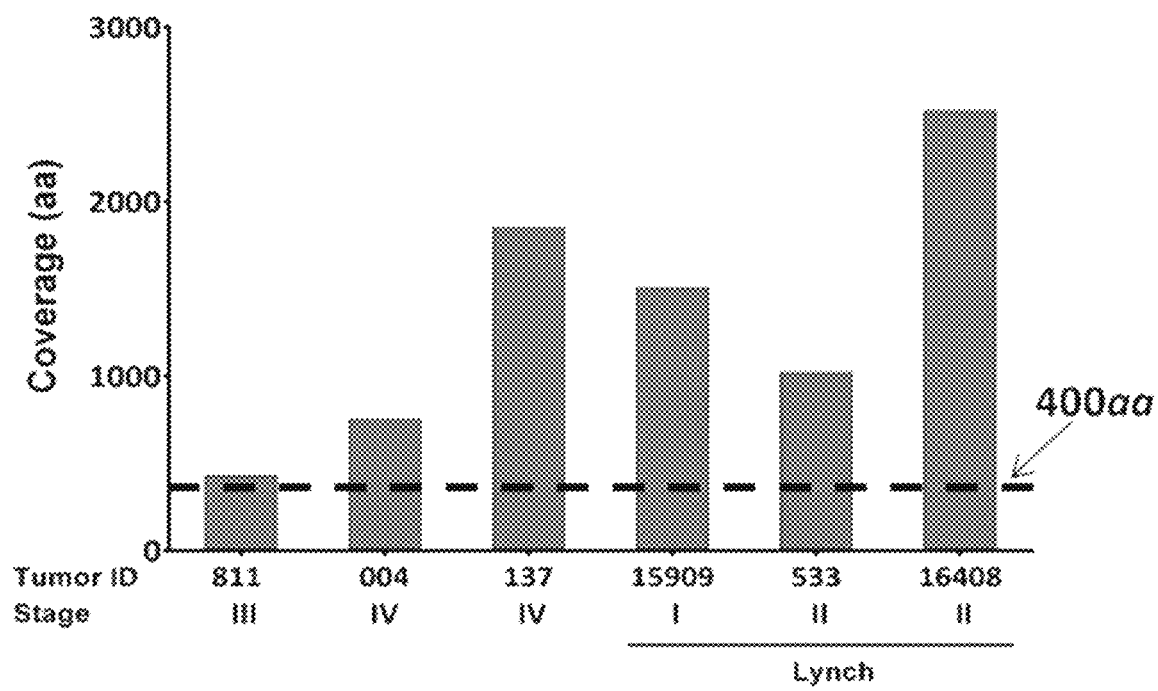

FIG. 3: Immunogenic coverage of Nous-209 in MSI CRC biopsies.

Figure 4:
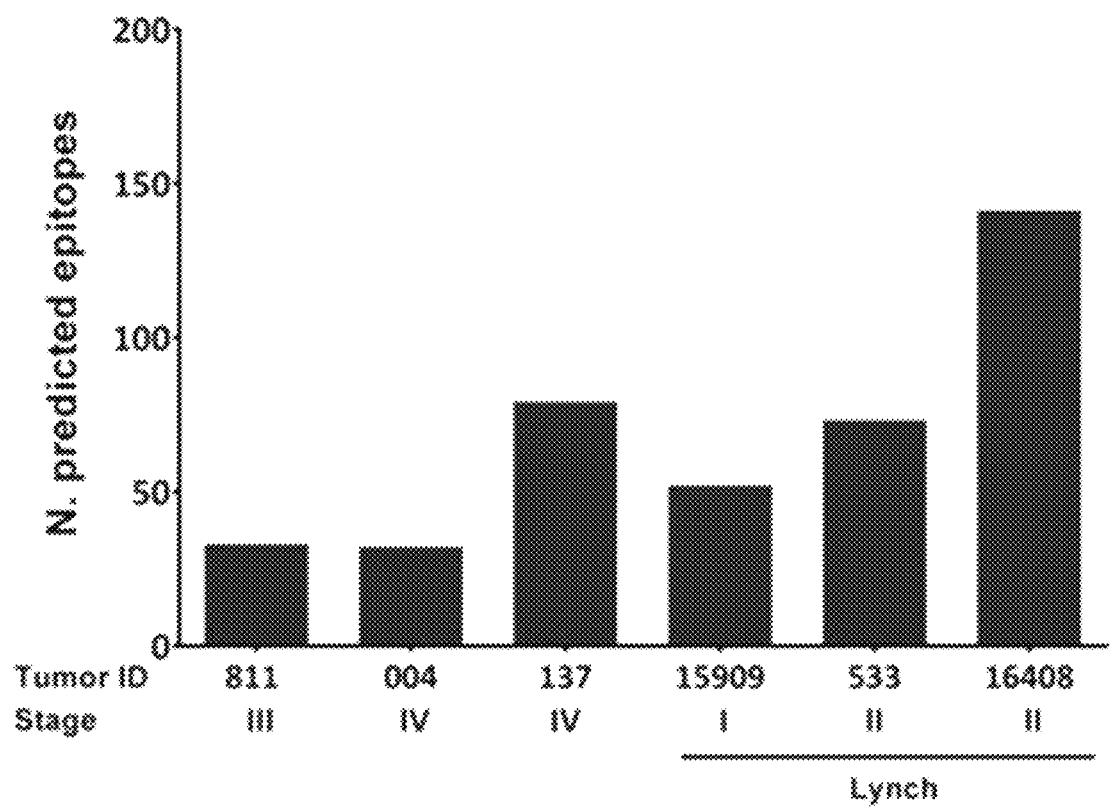

FIG. 4: Number of predicted MHC-I binding epitopes arising from Nous-209 in biopsies of MSI patients.

Figure 5:
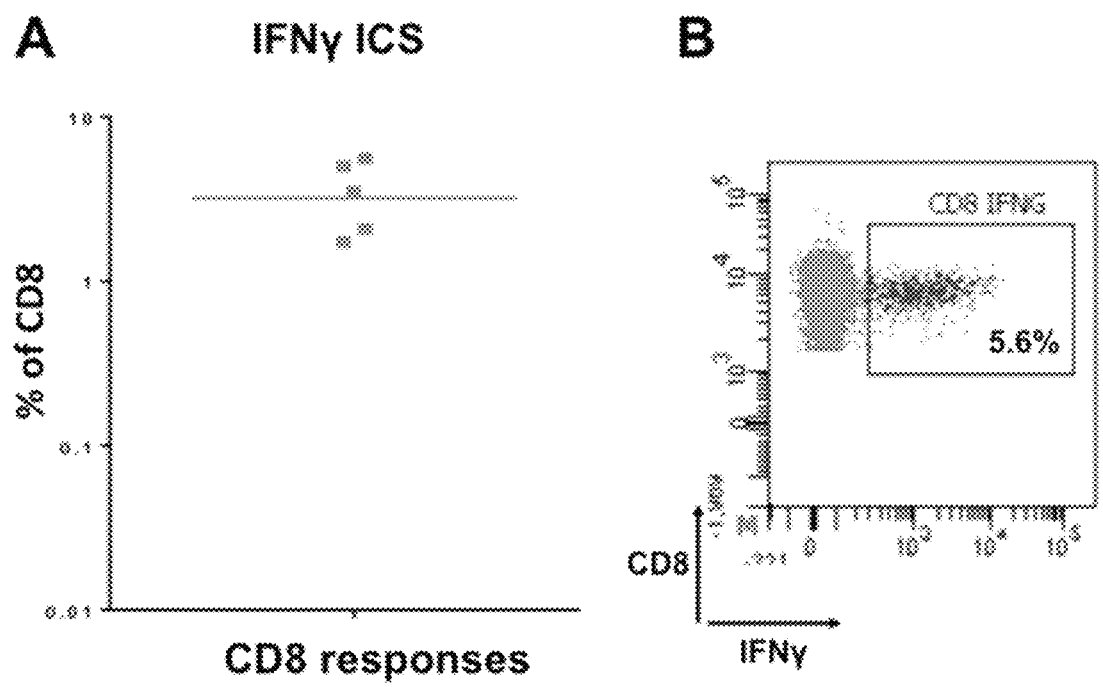

FIG. 5: The FSP corresponding to SEQ ID NO: 123 included in Nous-209 is immunogenic in vivo in HLA.A02 transgenic mice. A representative CD8 T cell response in 5 animals to a HLA-A02 nonamer present in FSP SEQ ID NO: 123, as measured by intracellular staining (ICS) for interferon γ (IFN-γ) (panel A). FACS plot of gating strategy for IFN-γ+ CD8 T cells from one of those mice showing a significant percentage (5.6%) of FSP-reactive T cells (panel B).

Figure 6:
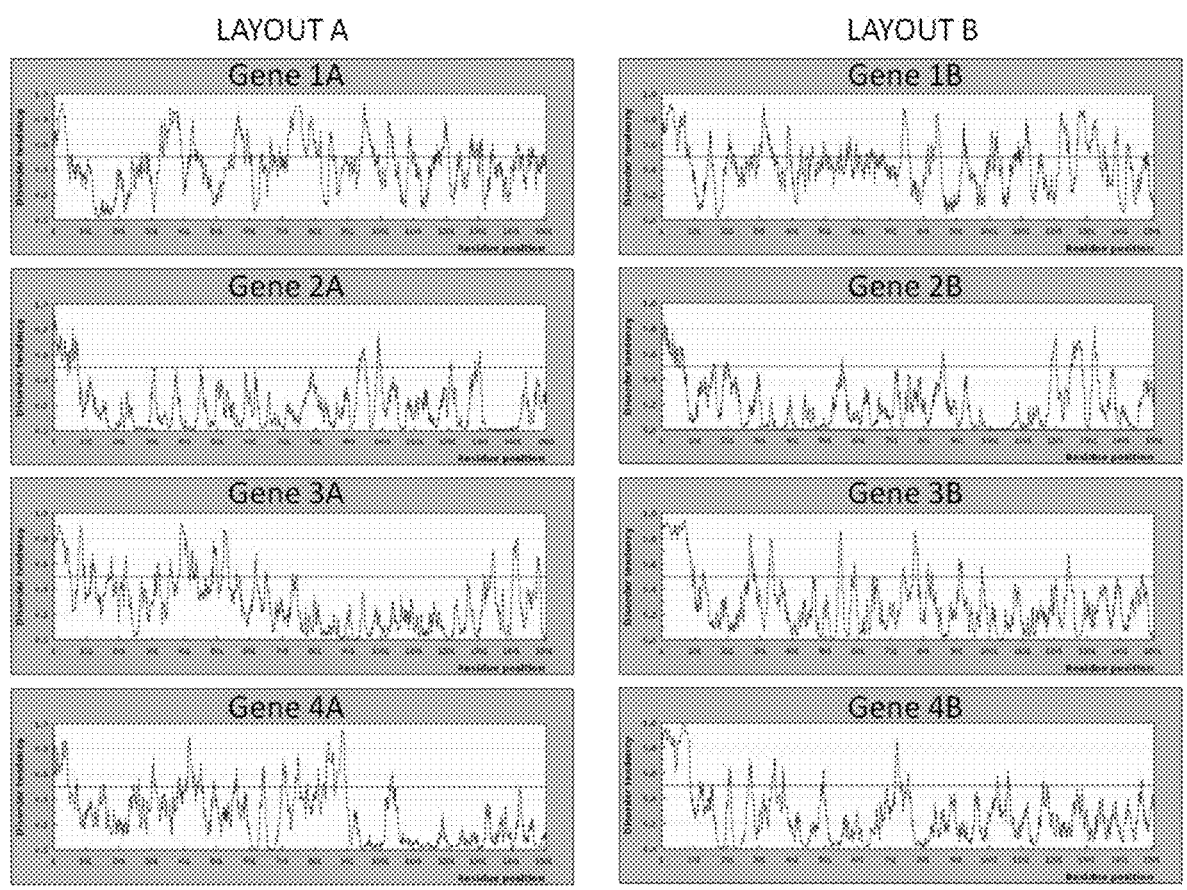

FIG. 6: Disorder profiles predicted by IUPRED for the eight artificial polypeptides containing Nous-209 FSPs in layout A and B.

Figure 7:
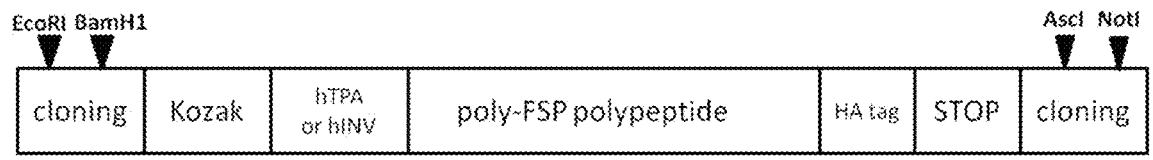

FIG. 7: Schematic view of the expression cassettes.

Figure 8:
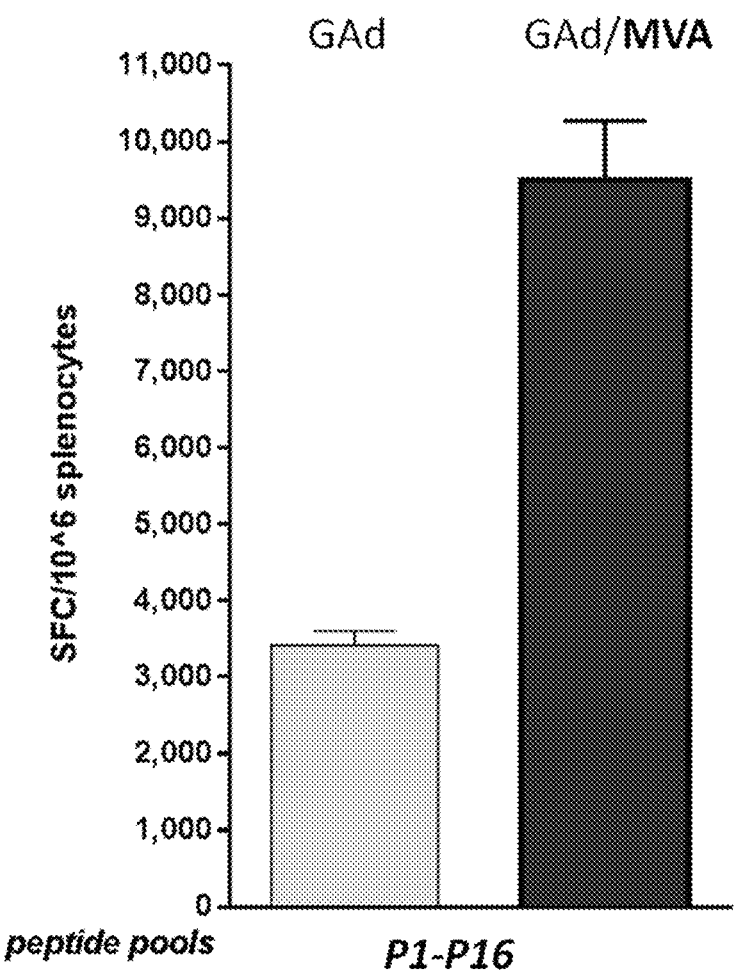

FIG. 8: Immunogenicity of GAd20-209-FSPs/MVA-209-FSPs prime/boost regimen in mice. IFNγ ELISpot responses are measured 2 weeks post GAd20-209-FSPs prime(GAd) and one-week post MVA-209-FSPs boost (GAd/MVA). Shown are the responses (number of T cells producing IFNγ per millions of splenocytes) to 16 pools of synthetic peptides (P1-P16) covering the polypeptide sequences of the 209 FSPs encoded by the vaccines.

Figure 9:
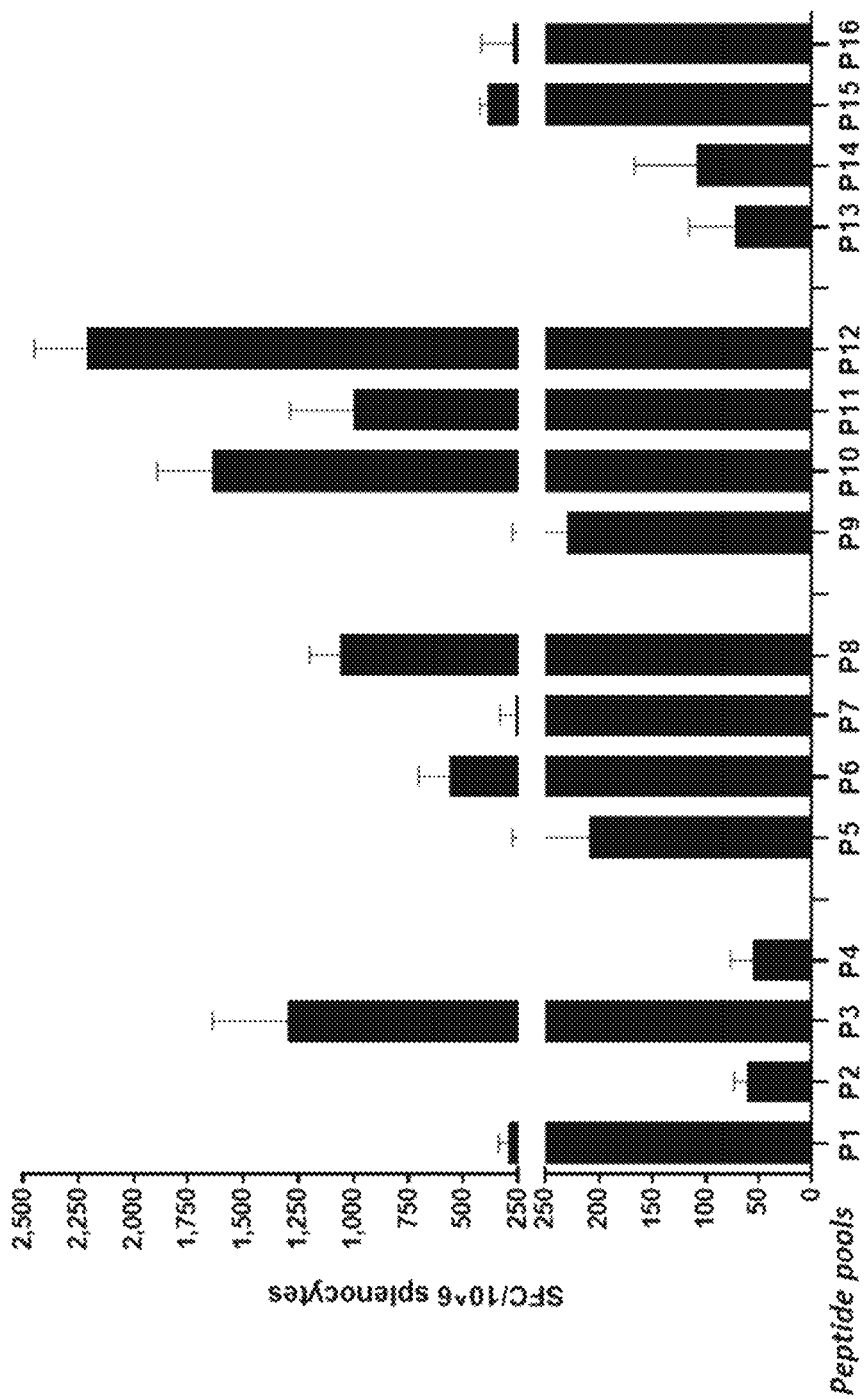

FIG. 9: Measurement of immune responses against each of the 16 pools covering the 209 FSP sequences. IFNγ ELISpot responses measured post boost on splenocytes of mice vaccinated with GAd20-209-FSPs/MVA-209-FSPs. Shown are the responses (number of T cells producing IFNγ per millions of splenocytes) to each of the 16 pools of synthetic peptides (from P1 to P16) covering the polypeptide sequences of the 209 FSPs encoded by the vaccine.

Figure 10:
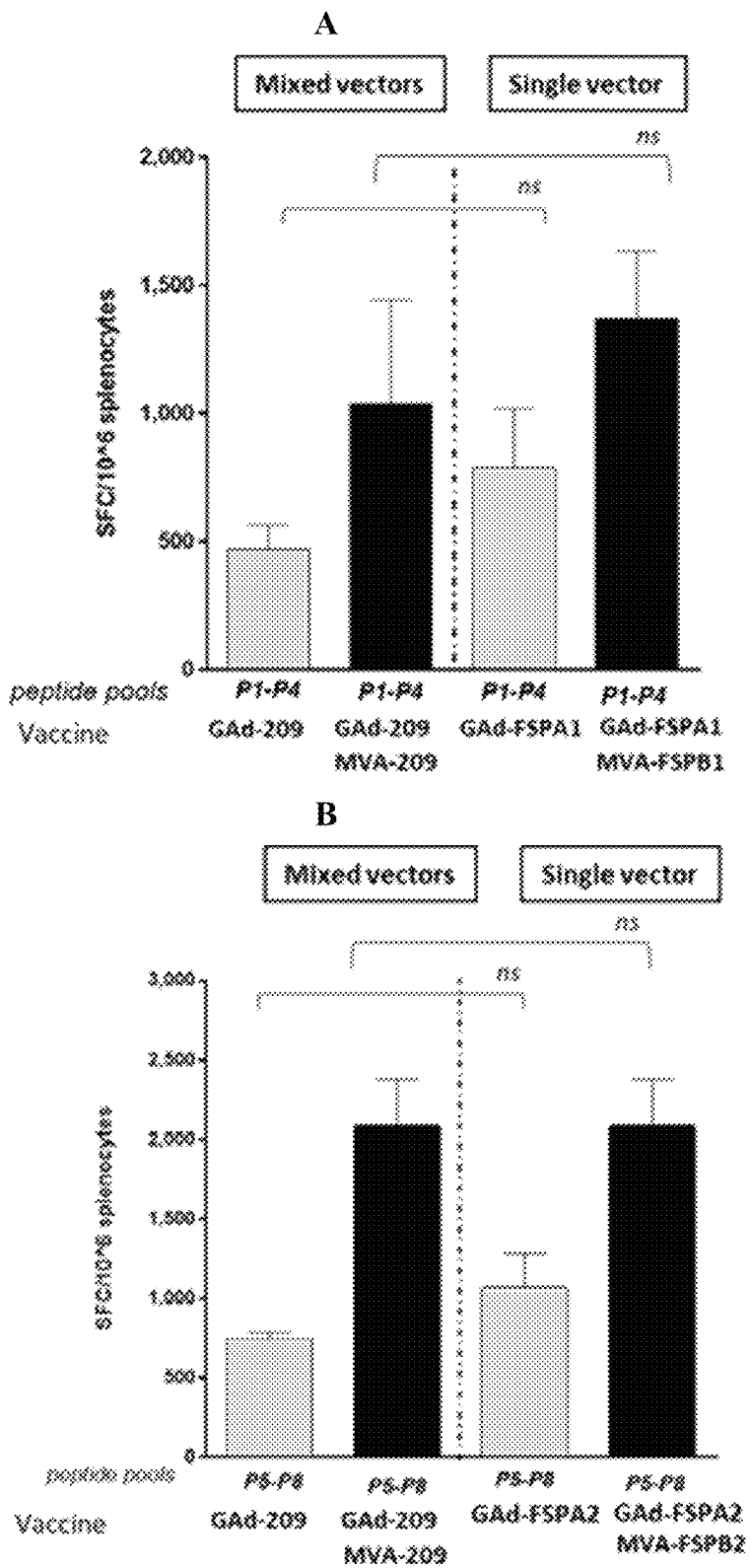

FIG. 10: Vaccine-induced immune responses against FSPs encoded by a single vector are not affected by vectors co-administration. IFNγ ELISpot responses are measured post prime (week2, gray bars) and post boost (week3, black bars) in mice immunized with a vector mixture or with single vectors. Shown are the responses (number of T cells producing IFNγ per millions of splenocytes) to the 4 pools of synthetic peptides (P1-P4) covering the sequences of the FSPs encoded by the vector FSPA1 (A) and to the 4 pools of synthetic peptides (P5-P8) covering the sequences of the FSPs encoded by the vector FSPA2 (B). Statistics are calculated by non-parametric Mann-Whitney U test (ns=p>0.05).

Figure 11:
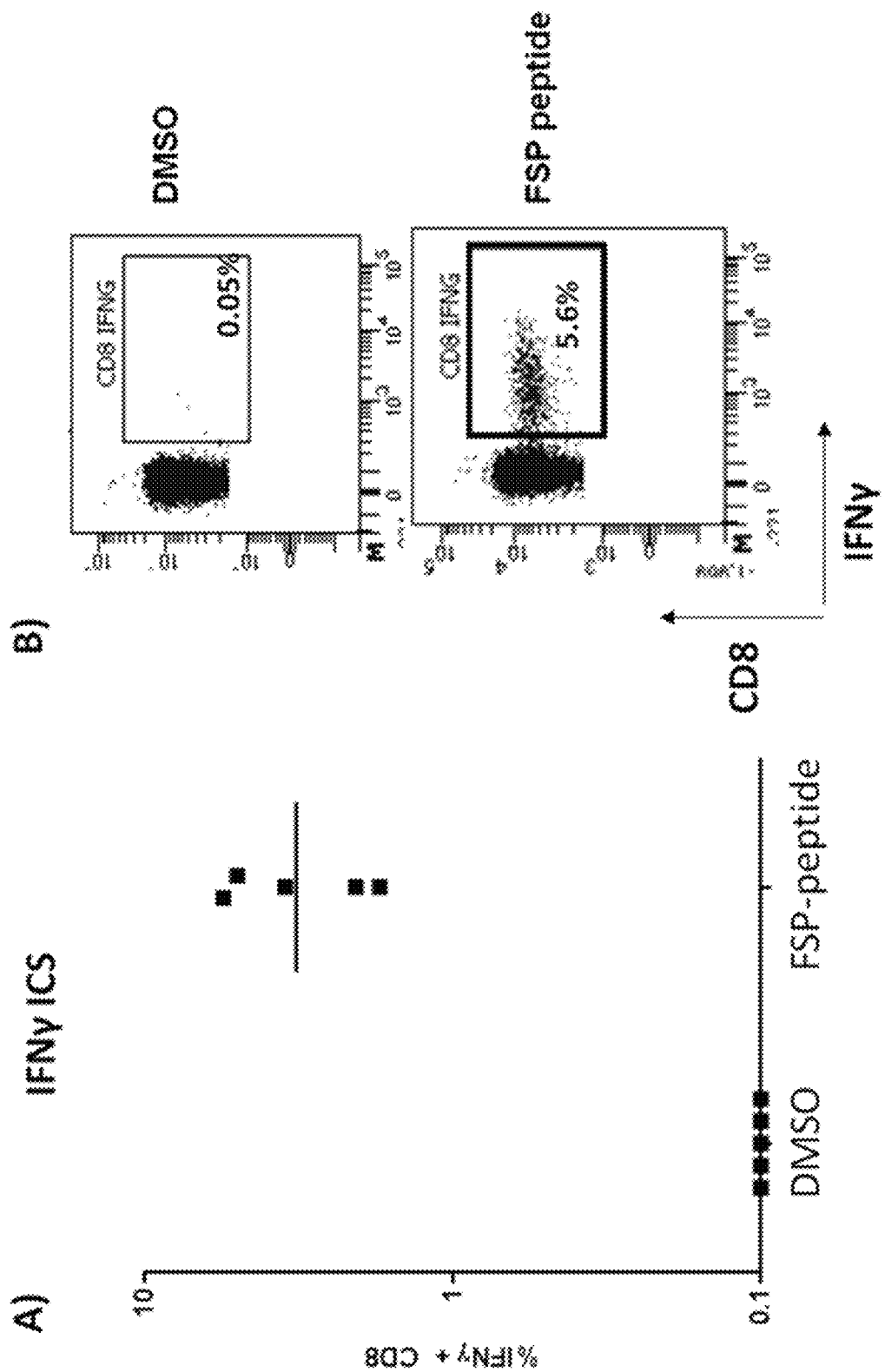

FIG. 11: The FSP corresponding to SEQ ID NO: 123 (FSP-peptide) included in Nous-209 is immunogenic in vivo in HLA.A02 transgenic mice. A) Percentage of IFNγ+ CD8+ FSP-specific T cells responses and responses observed for the DMSP control. B) FACS plot of gating strategy for IFN-γ+ CD8 T cells from one representative mouse sample for the DMSO control (top) and the FSP peptide (bottom).

DETAILED DESCRIPTION OF THE INVENTION

Before the present invention is described in detail below, it is to be understood that this invention is not limited to the particular methodology, protocols and reagents described herein as these may vary. It is also to be understood that the terminology used herein is for the purpose of describing particular embodiments only, and is not intended to limit the scope of the present invention which will be limited only by the appended claims. Unless defined otherwise, all technical and scientific terms used herein have the same meanings as commonly understood by one of ordinary skill in the art.

Preferably, the terms used herein are defined as described in "A multilingual glossary of biotechnological terms: (IUPAC Recommendations)", Leuenberger, H. G. W, Nagel, B. and Klbl, H. eds. (1995), Helvetica Chimica Acta, CH-4010 Basel, Switzerland) and as described in "Pharmaceutical Substances: Syntheses, Patents, Applications" by Axel Kleemann and Jurgen Engel, Thieme Medical Publishing, 1999; the "Merck Index: An Encyclopedia of Chemicals, Drugs, and Biologicals", edited by Susan Budavari et al., CRC Press, 1996, and the United States Pharmacopeia-25/National Formulary-20, published by the United States Pharmcopeial Convention, Inc., Rockville Md., 2001.

Throughout this specification and the claims which follow, unless the context requires otherwise, the word "comprise", and variations such as "comprises" and "comprising", will be understood to imply the inclusion of a stated feature, integer or step or group of features, integers or steps but not the exclusion of any other feature, integer or step or group of integers or steps. In the following passages different aspects of the invention are defined in more detail. Each aspect so defined may be combined with any other aspect or aspects unless clearly indicated to the contrary. In particular, any feature indicated as being preferred or advantageous may be combined with any other feature or features indicated as being preferred or advantageous.

Several documents are cited throughout the text of this specification. Each of the documents cited herein (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention.

Definitions

In the following, some definitions of terms frequently used in this specification are provided. These terms will, in each instance of its use, in the remainder of the specification have the respectively defined meaning and preferred meanings.

As used herein, the term "isolated" refers to a molecule which is substantially free of other molecules with which it is naturally associated with. In particular, isolated means the molecule is not in an animal body or an animal body sample. An isolated molecule is thus free of other molecules that it would encounter or contact in an animal. Isolated does not mean isolated from other components associated with as described herein, e.g. not isolated from other components of a composition the molecule is comprised in, or isolated from a vector or cell it is comprised in.

The terms "polynucleotide" and "nucleic acid" are used interchangeably herein and are understood as a polymeric or oligomeric macromolecule made from nucleotide monomers. Nucleotide monomers are composed of a nucleobase, a five-carbon sugar (such as but not limited to ribose or 2'-deoxyribose), and one to three phosphate groups. Typically, a nucleic acid is formed through phosphodiester bonds between the individual nucleotide monomers. In the context of the present invention preferred nucleic acid molecules include but are not limited to ribonucleic acid (RNA), modified RNA, deoxyribonucleic acid (DNA), and mixtures thereof such as e.g. RNA-DNA hybrids. The nucleic acids, can e.g. be synthesized chemically, e.g. in accordance with the phosphotriester method (see, for example, Uhlmann, E. & Peyman, A. (1990) Chemical Reviews, 90, 543-584)."

The term "open reading frame" abbreviated "ORF" is used in the context of the present invention to refer to a sequence of nucleotides that can be translated into a consecutive string of amino acids. Typically, an ORF contains a start codon, a subsequent region usually having a length which is a multiple of 3 nucleotides, but does not contain a stop codon (TAG, TAA, TGA, UAG, UAA, or UGA) in the given reading frame. An ORF codes for a protein where the amino acids into which it can be translated form a peptide-linked chain.

As used herein, the term "protein", "peptide", "polypeptide", "peptides" and "polypeptides" are used interchangeably throughout. These terms are used in the context of the present invention to refer to both naturally occurring peptides, e.g. naturally occurring proteins and synthesized peptides that may include naturally or non-naturally occurring amino acids. Peptides can be also chemically modified by modifying a side chain or a free amino or carboxy-terminus of a natural or non-naturally occurring amino acid. This chemical modification includes the addition of further chemical moieties as well as the modification of functional groups in side chains of the amino acids, such as a glycosylation. A peptide is a polymer preferably having at least 3, 4, 5, 6, 7, 8, 9, 10, 15, 20, 25, 30, 35, 40, 45, 50, 55, 60, 65, 70, 75, 80, 85, 90, 95, or at least 100 amino acids, most preferably at least 8 or at least 30 amino acids.

The term "frame-shift mutation" abbreviated as "FSM" is used in the context of the present invention to refer to an alteration of the nucleic acid sequence within the ORF encoding a protein, which leads to an alteration of the reading frame downstream of the mutation and, thus to a protein with an altered sequence in comparison to the wild-type protein. A frame-shift mutation results, if a number of nucleotides is inserted or deleted in an ORF that cannot be divided by 3. Typically, FSM result if one or two nucleotides are deleted or inserted. Deletions are more frequent than insertions. If one or two nucleotides are deleted within the codon of an ORF an altered codon will be formed with one or two nucleotides 3' of the affected codon. Unless this altered codon is a stop codon the translation product of the ORF will be determined by the altered codon and an alternate ORF 3' of the altered codon up to the next stop codon. If one or two nucleotides are inserted into a codon a new codon is generated that will comprise two or one nucleotides of the previous nucleotides and one or two of the inserted nucleotides. Unless this new codon is a stop codon the translation product of the ORF will be determined by the new codon and an alternate ORF 3' of the new codon up to the next stop codon.

The term "frame-shift codon" abbreviated as "FC" is used in the context of the present invention to refer to the first codon at the 3' of the FSM that encodes a different amino acid compared to the wt sequence.

The term "collection of nucleic acids comprising FSMs" abbreviated as "CFSM" is used in the context of the present invention to refer to a list of separate nucleotide sequences each including a FSM that may represent all FSMs observed in a particular MSI cancer type, e.g. colorectal, endometrial or gastric cancer or two or more MSI cancers or a subgroup of FSMs that is selected according to one or more of the criteria outlined in detail below.

The term "frame-shift peptide" abbreviated as "FSP" is used in the context of the present invention to refer to the complete translation product of the protein-encoding segment of a nucleic acid comprising a FSM of an CFSM starting from the FC.

The term "a collection of frame-shift peptides" abbreviated as "CFSP" is used in the context of the present invention to refer to a list of amino acid sequences of FSP may represent all FSPs observed in a particular MSI cancer type, e.g. colorectal, endometrial or gastric cancer or two or more MSI cancers or a subgroup of FSPs that is selected according to one or more of the criteria outlined in detail below.

The term "modified FSP" abbreviated as "mFSP" is used in the context of the present invention to refer to a peptide having an amino acid sequence that is based on a FSP but that is modified compared to the FSP by addition or deletion of amino acids to render that particular FSP more suitable for inclusion into a collection of peptides that form a cancer vaccine peptide collection. The criteria for selecting FSPs that may benefit from modification and the particular modification are outlined in detail below.

The term "cancer vaccine peptide collection" abbreviated as "CVP" is used in the context of the present invention to refer to FSPs and/or mFSPs either in the form of individual peptides or as linked to each other. Preferably, two or more different FSPs and/or mFSPs are linked to each other by peptide bonds forming polypeptides. The linkage may be directly or through one or more linker amino acids, e.g. small flexible amino acids like Gly, Ser, or Ala. In order to avoid the generation of further antigens its it preferred that the peptides are linked directly to each other. It is preferred to link the FSPs and/or mFSPs together to form polypeptides. It is known that the translation efficiency of very long mRNAs decreases and, therefore it is preferred that CVPs comprising FSPs and mFSPs of a total length of more than 1.000 amino acids, more preferably of more than 1.500 amino acids are split into separate polypeptides. E.g. if the CVP comprises FSPs and/or mFSPs of about 6.000 amino acid than it is preferred that the FSPs and/or mFSPs are linked to form four separate polypeptides each comprising FSPs and/or mFSPs of a total length of about 1.500 amino acids.

The term "microsatellite instability" abbreviated as "MSI" is defined as alterations in the length of microsatellites due to the deletion or insertion of one or more repeat units in the microsatellite regions. This generates novel microsatellite alleles with altered total length in the genomic DNA of the tumor cells when compared with the genomic DNA in normal/germline cells from the same individual. This condition of genetic hypermutability results from impaired DNA mismatch repair (MMR). MMR is a mechanism that corrects spontaneous mutations that occur in genomic DNA during DNA replication. Typically, the mutations are single base mismatches of short nucleotide insertions or deletions. The latter two may result in a frameshift mutation if occurring in an ORF and if the length of the inserted or deleted nucleotide sequence is not dividable by three (see above definition of FSM).

The term "MSI phenotype" refers to the diagnosis of a change in the length of repeated nucleotides, most often GT/CA repeats. Such repeats occur throughout the genomic DNA of healthy subjects and make up about 3% of the human genome. The skilled person is well aware how to determine MSI phenotype in a sample. A preferred way is the use of a Promega (Madison, Wis.) MSI Analysis System (v 1.2), comprehensive of 7 markers, according to the guidelines established during the National Cancer Institute (NCI) Workshop on Microsatellite Instability.

The term "neo-epitope" is used in the context of the present invention to refer to an epitope encoded by the tumor that is not present in normal/germline cells but occurs in precancerous and/or, cancerous cells, in particular having an MSI phenotype.

The term "expression cassette" is used in the context of the present invention to refer to a nucleic acid molecule which comprises at least one nucleic acid sequence that is to be expressed, e.g. a nucleic acid encoding the CVP of the present invention or a part thereof, operably linked to transcription and translation control sequences. Preferably, an expression cassette includes cis-regulating elements for efficient expression of a given gene, such as promoter, initiation-site and/or polyadenylation-site. Preferably, an expression cassette contains all the additional elements required for the expression of the nucleic acid in the cell of a patient. A typical expression cassette thus contains a promoter operatively linked to the nucleic acid sequence to be expressed and signals required for efficient polyadenylation of the transcript, ribosome binding sites, and translation termination. Additional elements of the cassette may include, for example enhancers. An expression cassette preferably also contains a transcription termination region downstream of the structural gene to provide for efficient termination. The termination region may be obtained from the same gene as the promoter sequence or may be obtained from a different gene.

The term "operably linked" as used in the context of the present invention refers to an arrangement of elements, wherein the components so described are configured so as to perform their usual function. A nucleic acid is "operably linked" when it is placed into a functional relationship with another nucleic acid sequence. For example, a promoter is operably linked to one or more transgenes, if it affects the transcription of the one or more transgenes. Further, control elements operably linked to a coding sequence are capable of effecting the expression of the coding sequence. The control elements need not be contiguous with the coding sequence, so long as they function to direct the expression thereof. Thus, for example, intervening untranslated yet transcribed sequences can be present between a promoter sequence and the coding sequence and the promoter sequence can still be considered "operably linked" to the coding sequence.

The term "expression vector" refers to a polynucleotide or a mixture of a polynucleotide and proteins capable of being introduced or of introducing the collection of nucleic acids of the present invention or one nucleic acid that is part of the collection of nucleic acids of the invention into a cell, preferably a mammalian cell. Examples of vectors include but are not limited to plasmids, cosmids, phages, viruses or artificial chromosomes. In particular, a vector is used to transport the promoter and the collection of the nucleic acids or one nucleic acid that is part of the collection of nucleic acids of the invention into a suitable host cell. Expression vectors may contain "replicon" polynucleotide sequences that facilitate the autonomous replication of the expression vector in a host cell. Once in the host cell, the expression vector may replicate independently of or coincidental with the host chromosomal DNA, and several copies of the vector and its inserted DNA can be generated. In case that replication incompetent expression vectors are used—which is often the case for safety reasons—the vector may not replicate but merely direct expression of the nucleic acid. Depending on the type of expression vector the expression vector may be lost from the cell, i.e only transiently expresses the CVP encoded by the nucleic acid or may be stable in the cell. Expression vectors typically contain expression cassettes, i.e. the necessary elements that permit transcription of the nucleic acid into an mRNA molecule.

The term "antigen" is used in the context of the present invention to refer to any structure recognized by molecules of the immune response, e.g. antibodies, T cell receptors (TCRs) and the like. Preferred antigens are cellular proteins that are associated with a particular disease. Antigens are recognized by highly variable antigen receptors (B-cell receptor or T-cell receptor) of the adaptive immune system and may elicit a humoral or cellular immune response. Antigens that elicit such a response are also referred to as immunogen. A fraction of the proteins inside cells, irrespective of whether they are foreign or cellular, are processed into smaller peptides and presented to by the major histocompatibility complex (MHC). A cellular immune response is elicited, if the small peptide fragment is bound by a T-cell receptor.

The term "epitope", also known as antigenic determinant, is used in the context of the present invention to refer to the segment of an antigen, preferably peptide that is bound by molecules of the immune system, e.g. B-cell receptors, T-cell receptors or antibodies. The epitopes bound by antibodies or B cells are referred to as "B cell epitopes" and the epitopes bound by T cells are referred to as "T cell epitopes". In this context, the term "binding" preferably relates to a specific binding, which is defined as a binding with an association constant between the antibody or T cell receptor (TCR) and the respective epitope of $1 \times 10^5$ M-1 or higher, preferably of $1 \times 10^6$ M-1, $1 \times 10^7$ M-1, $1 \times 10^8$ M-1 or higher. The skilled person is well aware how to determine the association constant (see e.g. Caoili, S. E. (2012) Advances in Bioinformatics Vol. 2012). Preferably, the specific binding of antibodies to an epitope is mediated by the Fab (fragment, antigen binding) region of the antibody, specific binding of a B-cell is mediated by the Fab region of the antibody comprised by the B-cell receptor and specific binding of a T-cell is mediated by the variable (V) region of the T-cell receptor. T cell epitopes are presented on the surface of an antigen presenting cell, where they are bound to Major Histocompatiblilty (MHC) molecules. There are at least three different classes of MHC molecules termed MHC class I, II and III molecules, respectively. Epitopes presented through the MHC-I pathway elicit a response by cytotoxic T lymphocytes (CD8+ cells), while epitopes presented through the MHC-II pathway elicit a response by T-helper cells (CD4+ cells). T cell epitopes presented by MHC Class I molecules are typically peptides between 8 and 11 amino acids in length and T cell epitopes presented by MHC Class II molecules are typically peptides between 13 and 17 amino acids in length. MHC Class III molecules also present non-peptidic epitopes such as glycolipids. Accordingly, the term "T cell epitope" preferably refers to a 8 to 11 or 13 to 17 amino acid long peptide that can be presented by either a MHC Class I or MHC Class II molecule. Epitopes usually consist of chemically active surface groupings of amino acids, which may or may not carry sugar side chains and usually have specific three-dimensional structural characteristics, as well as specific charge characteristics. Conformational and non-conformational epitopes are distinguished in that the binding to the former but not the latter is lost in the presence of denaturing solvents.

The term "junctional epitope" as used in the context of the present invention refers to an epitope that is not present in an isolated FSP, mFSP and/or antigenic fragment thereof of a given CVP but comprises an amino acid sequence formed upon linking two peptides, e.g. two FSPs by a peptide bond. For example, a list of all potential junction epitopes of the assembled peptides with 8 consecutive amino acids may be created wherein 1 to 7 amino acids of the first peptide and 7 to 1 amino acids from the second peptide are included encompassing the linking peptide bond. This list is then compared to the amino acid sequence of all FSPs and mFSPs of the CVP in order to identify all potential junctional epitopes.

The term "non-MSI cancer epitope" refers to an epitope of a protein that is specifically expressed in cancer cells but which is not due to a FSM. Such an epitope is considered specific if it is at least 10-fold more abundant in cancer cells than in healthy cells. Examples of such epitopes are proteins whose expression is upregulated in cancer cells like, e.g. tyrosinase in melanomas or Her-2 receptor in breast cancer, or that are mutated in certain cancers like e.g. p53.

The term "immunogenic coverage" refers to the expected number of immunogenic epitopes that the vaccine is likely to elicit in a patient. A vaccine encoding a set of FSPs that are present in a patient's tumor for a cumulative length of 400 amino acids is expected to elicit on average 3 immunogenic epitopes and is providing good immunogenic coverage.

The term "an antigenic fragment thereof" as used in the context of the present invention refers to a fragment of an antigen, preferably a FSP or mFSP, wherein the fragment is also antigenic, i.e. is capable of eliciting a B and/or T cell immune response in a mammal. Preferably the antigenic "fragments of FSPs and/or mFSPs" are at least 8 amino acid long continuous stretches of the FSPs and mFSPs as defined above and in more detail below. Fragments of a mFSP comprises at least 4 amino acids of the FSP on which the mFSP is based.

The term "collection of nucleic acids encoding the CVP" is used in the context of the present invention to refer to one or more consecutive nucleic acid sequences encoding a polypeptide comprising all FSPs and/or mFSPs or antigenic fragments thereof of the CVP, encoding 2, 3, 4, 5, 6, 7, 8, 9, or 10 or more, preferably four polypeptides comprising all FSPs and/or mFSPs of the CVP. Thus, the term comprises in one embodiment a single nucleic acid encoding the CVP and in the other most extreme embodiment the collection of nucleic acid comprises a separate nucleic acid for each FSP and/or mFSP or antigenic fragment thereof.

The terms "preparation" and "composition" as used in the context of the present invention are intended to include the formulation of the active compound, e.g. the VLPs of the present invention with a carrier and/or excipient.

"Pharmaceutically acceptable" as used in the context of the present invention means approved by a regulatory agency of the Federal or a state government or listed in the U.S. Pharmacopeia or other generally recognized pharmacopeia for use in animals, and more particularly in humans.

The term "carrier", as used herein, refers to a pharmacologically inactive substance such as but not limited to a diluent, excipient, surfactants, stabilizers, physiological buffer solutions or vehicles with which the therapeutically active ingredient is administered. Such pharmaceutical carriers can be liquid or solid. Liquid carrier include but are not limited to sterile liquids, such as saline solutions in water and oils, including but not limited to those of petroleum, animal, vegetable or synthetic origin, such as peanut oil, soybean oil, mineral oil, sesame oil and the like. Saline solutions and aqueous dextrose and glycerol solutions can also be employed as liquid carriers, particularly for injectable solutions. A saline solution is a preferred carrier when the pharmaceutical composition is administered intravenously. Examples of suitable pharmaceutical carriers are described in "Remington's Pharmaceutical Sciences" by E. W. Martin.

Suitable pharmaceutical "excipients" include starch, glucose, lactose, sucrose, gelatine, malt, rice, flour, chalk, silica gel, sodium stearate, glycerol monostearate, talc, sodium chloride, dried skim milk, glycerol, propylene, glycol, water, ethanol and the like.

"Surfactants" include anionic, cationic, and non-ionic surfactants such as but not limited to sodium deoxycholate, sodium dodecylsulfate, Triton X-100, and polysorbates such as polysorbate 20, polysorbate 40, polysorbate 60, polysorbate 65 and polysorbate 80.

"Stabilizers" include but are not limited to mannitol, sucrose, trehalose, albumin, as well as protease and/or nuclease antagonists.

"Physiological buffer solution" that may be used in the context of the present invention include but are not limited to sodium chloride solution, demineralized water, as well as suitable organic or inorganic buffer solutions such as but not limited to phosphate buffer, citrate buffer, tris buffer (tris (hydroxymethyl)aminomethane), HEPES buffer ([4 (2 hydroxyethyl)piperazino]ethanesulphonic acid) or MOPS buffer (3 morpholino-1 propanesulphonic acid). The choice of the respective buffer in general depends on the desired buffer molarity. Phosphate buffer are suitable, for example, for injection and infusion solutions.

The term "adjuvant" refers to agents that augment, stimulate, activate, potentiate, or modulate the immune response to the active ingredient of the composition at either the cellular or humoral level, e.g. immunologic adjuvants stimulate the response of the immune system to the actual antigen, but have no immunological effect themselves. Examples of such adjuvants include but are not limited to inorganic adjuvants (e.g. inorganic metal salts such as aluminium phosphate or aluminium hydroxide), organic adjuvants (e.g. saponins or squalene), oil-based adjuvants (e.g. Freund's complete adjuvant and Freund's incomplete adjuvant), cytokines (e.g. IL-1β, IL-2, IL-7, IL-12, IL-18, GM-CFS, and INF-γ) particulate adjuvants (e.g. immuno-stimulatory complexes (ISCOMS), liposomes, or biodegradable microspheres), virosomes, bacterial adjuvants (e.g. monophosphoryl lipid A, or muramyl peptides), synthetic adjuvants (e.g. non-ionic block copolymers, muramyl peptide analogues, or synthetic lipid A), or synthetic polynucleotides adjuvants (e.g polyarginine or polylysine).

An "effective amount" or "therapeutically effective amount" is an amount of a therapeutic agent sufficient to achieve the intended purpose. The effective amount of a given therapeutic agent will vary with factors such as the nature of the agent, the route of administration, the size and species of the animal to receive the therapeutic agent, and the purpose of the administration. The effective amount in each individual case may be determined empirically by a skilled artisan according to established methods in the art.

As used herein, "treat", "treating", "treatment" or "therapy" of a disease or disorder means accomplishing one or more of the following: (a) reducing the severity of the disorder; (b) limiting or preventing development of symptoms characteristic of the disorder(s) being treated; (c) inhibiting worsening of symptoms characteristic of the disorder(s) being treated; (d) limiting or preventing recurrence of the disorder(s) in an individual that has previously had the disorder(s); and (e) limiting or preventing recurrence of symptoms in individuals that were previously symptomatic for the disorder(s).

Aspects of the Invention and Preferred Embodiments

In a first aspect, the present invention relates to a method of selecting a collection of frame-shift peptides (CFSP) for producing a universal micro-satellite instability (MSI) cancer vaccine peptide collection (CVP) for prophylaxis or treatment of a patient with a cancer comprising hereditary and sporadic MSI cancer or being at risk of developing such a cancer, comprising the steps of:
(i) selecting a collection of nucleic acids (CFSM) each comprising a frame-shift mutation (FSM) each FSM being present in one or more of at least M cancer samples (CS) each of a different patient, wherein the cancer of the patient comprises cancer cells with an MSI phenotype; wherein at least 50% of the FSM that are selected fulfill criteria (a), (b), (c) and/or (d):
  (a) the FSM is present in a mononucleotide repeat (MNR) of coding genes with a length equal to or longer than 6 nucleotides;
  (b) the FSM corresponds to a deletion of 1 nucleotide;
  (c) the number of DNA sequencing reads harboring the FSM is significantly higher in the tumor sample as compared to the matched normal sample (FDR-corrected Fisher test p-value equal to or lower than 0.05);
  (d) the FSM is present in the matched normal samples with an allele frequency lower than 25%,
(ii) selecting X different frame-shift peptides (FSPs), wherein each selected FSP is the complete translation product of the protein-encoding segment of a nucleic acid comprising a FSM of the CFSM of at least 4 amino acid length, starting from the codon encoding the first amino acid that is different relative to the translation product of the corresponding wild type (wt) nucleic acid without the FSM, wherein X is at least 20 more preferably at least 35 and M is at least 5.

By selecting a certain number and types of FSPs according to the method of the first aspect, induction of T cells against a number of FSP is ensured by the vaccination. The expected number of T cell immunogenic epitopes based on the 400 aa rule is at least one immunogenic epitope every 400aa and therefore at least 16 for a vaccine encoding for a total length of 6021aa. The inventors have indeed demonstrated in the mouse model that vaccination with 209 FSP for a total length of 6021 aa was able to induce a T cell response against at least 16 different FSP, corresponding to at least 1 every 376 aa (FIG. 9), this confirms the immunogenic rule. The selected vaccination platform based on genetic vectors, differently from peptide vaccination, ensured that the immunogenicity of an individual FSP is not suppressed by another FSP present in the vaccine. The inventors have demonstrated in a mouse model that competition is not occurring, by showing that administration of only one of the four vaccine vectors generates virtually identical responses compared to administration of a mix of four vaccine vectors.

In one embodiment, the FSPs selected in step (ii) can be described as candidate FSPs for producing a universal MSI CVP for prophylaxis or treatment of a patient with a cancer comprising hereditary and sporadic MSI cancer or being at risk of developing such a cancer. "Candidate" means that the FSPs potentially have a prophylactic or therapeutic effect. This can be expected based on the selection process and their structure.

The selection criterion (c) requires that the prevalence of a given FSM is significantly higher, i.e. more prevalent in the genomic DNA of one or more tumor samples than in matched normal samples from a healthy subject or healthy subjects. In this context the term "significantly higher" means that the prevalence of a given FSM relative to the prevalence of the wt un-mutated MNR is significantly higher in the tumor sample as compared to the normal sample according to a false-discovery-rate (FDR) corrected Fisher-test p-value equal to or smaller than 0.1, more preferably smaller than 0.05, more preferably smaller than 0.01 and even more preferably smaller than 0.005. The lower the value the more suited the FSM is for inclusion in the CFSM, since the likelihood of the stimulation of an unwanted immune reaction against healthy tissue decreases. This criterion is assessed by sequencing either genomic DNA or cDNA from the samples. It is preferred that 50% of the FSMs selected for the CFSM fulfill criterion (c), more preferably at least 60%, more preferably at least 70%, more preferably at least 80%, more preferably at least 90%, more preferably at least 95% and most preferably at least 100%.

While criterion (c) relates to the relative prevalence of a given FSM, criterion (d) relates to the absolute prevalence of a given FSM in the alleles of normal samples. It is preferred that the FSM selected for the CFSM has a low overall prevalence in the alleles of normal samples. Preferably, the allele frequency in normal samples is lower than 40%, more preferably lower than 35%, more preferably lower than 30%, more preferably lower than 25%, more preferably lower than 20% and even more preferably lower than 10%. It is preferred that 50% of the FSMs selected for the CFSM fulfill criterion (d), more preferably at least 60%, more preferably at least 70%, more preferably at least 80%, more preferably at least 90%, more preferably at least 95% and most preferably at least 100%.

It is preferred that the FSMs selected for the CFSM fulfill both criterions (c) and (d). It is preferred that 50% of the FSMs selected for the CFSM fulfill criterion (c) and (d), more preferably at least 60%, more preferably at least 70%, more preferably at least 80%, more preferably at least 90%, more preferably at least 95% and most preferably at least 100%. Preferably, at least 50% also fulfill criterions (a) and/or (b).

In another preferred embodiment the FSMs selected for the CFSM fulfill criterion (a). It is preferred that 50% of the FSMs selected for the CFSM fulfill criterion (a), more preferably at least 60%, more preferably at least 70%, more preferably at least 80%, more preferably at least 90%, more preferably at least 95% and most preferably at least 100%.

In another preferred embodiment the FSMs selected for the CFSM fulfill criterion (b). It is preferred that 50% of the FSMs selected for the CFSM fulfill criterion (b), more preferably at least 60%, more preferably at least 70%, more preferably at least 80%, more preferably at least 90%, more preferably at least 95% and most preferably at least 100%.

In another preferred embodiment the FSMs selected for the CFSM fulfill criterion (a), (c) and (d). It is preferred that 50% of the FSMs selected for the CFSM fulfill criterion (a), (c) and (d), more preferably at least 60%, more preferably at least 70%, more preferably at least 80%, more preferably at least 90%, more preferably at least 95% and most preferably at least 100%.

In another preferred embodiment the FSMs selected for the CFSM fulfill criterion (b), (c) and (d). It is preferred that 50% of the FSMs selected for the CFSM fulfill criterion (b), (c) and (d), more preferably at least 60%, more preferably at least 70%, more preferably at least 80%, more preferably at least 90%, more preferably at least 95% and most preferably at least 100%.

In another preferred embodiment the FSMs selected for the CFSM fulfill criterion (a), (b), (c) and (d). It is preferred that 50% of the FSMs selected for the CFSM fulfill criterion (a), (b), (c) and (d), more preferably at least 60%, more preferably at least 70%, more preferably at least 80%, more preferably at least 90%, more preferably at least 95% and most preferably at least 100%.

The method of the invention provides a CVP that is suitable to treat MSI cancer of not only a particular patient but of many different patients with MSI cancer, i.e. is a universal CVP for the treatment of MSI cancers. For the same reason, it will also be suitable to have a prophylactic effect against the development of MSI cancers. Accordingly, the selection of FSMs in the method of the present invention is not based on the analysis of a cancer sample from just one patient but uses the information of several cancer samples from different patients. To obtain an appropriate diversity at least 5 cancer samples (CS) of different patients are analyzed to determine FSMs. As outlined above, this is preferably done by whole genome sequencing, by exome sequencing or by sequencing cDNAs generated from mRNA isolated from the samples. Cancer samples are used from patients that have a MSI cancer. This may be ascertained by detecting an MSI phenotype in cells comprised in the cancer sample. The CS may be of the same MSI cancer, i.e. originate from the same tissue, or from two or more different MSI cancers. It is particularly preferred and provides a particularly broadly usable CVP if a CS of MSI cancers of two or more different MSI cancers are used in the selection process. Preferred MSI cancers from which samples are derived are colorectal cancer and gastric cancer, colorectal cancer and endometrial cancer, gastric cancer and endometrial cancer and gastric cancer, colorectal cancer and endometrial cancer.

The selection process outlined on the basis of the FSMs can also be carried out on the basis of the FSP encoded by a particular nucleic acid comprising a FSM, i.e. criterions (c) and (d) can also be assessed by comparing the respectively encoded amino acid sequences rather than the nucleic acid sequences. It is immediately apparent to the skilled person that the presence of a FSM in a cancer or normal sample can also be assessed by determining the number of the encoded protein amino acid sequence comprising a FSP at their C-terminus rather than the C-terminus of the wild-type protein sequence.

The present inventors further envision to select the FSPs that are included in the CFSP by using one or more of the following criteria:
(a) the FSP is encoded by a FSM that is observed with a cancer type-specific frequency (CF) observed for a subset of CS of a specific type of cancer that are part of the collection of M different CSs that is at least 5% for at least one of the cancer types present in the CS; and/or
(b) the average mRNA expression level of the gene with the FSM encoding the FSP is in the top $80^{th}$ percentile of the distribution describing the average mRNA expression values of each protein-encoding gene across the CS; and/or
(c) the FSM generating the FSP is observed in less than 2% in normal tissues in a cohort of subjects without a cancer.

Preferably, at least 50% of the FSPs included in the CFSP fulfill criterion (a), (b), (c), (a)+(b), (a)+(c), (b)+(c) or (a)+(b)+(c). It is preferred that 60% of the FSPs selected for the CFSP fulfill criterion (a), (b), (c), (a)+(b), (a)+(c), (b)+(c) or (a)+(b)+(c), more preferably at least 70% of the FSPs selected for the CFSP fulfill criterion (a), (b), (c), (a)+(b), (a)+(c), (b)+(c) or (a)+(b)+(c), more preferably at least 80% of the FSPs selected for the CFSP fulfill criterion (a), (b), (c), (a)+(b), (a)+(c), (b)+(c) or (a)+(b)+(c), more preferably at least 90% of the FSPs selected for the CFSP fulfill criterion (a), (b), (c), (a)+(b), (a)+(c), (b)+(c) or (a)+(b)+(c), more preferably at least 95% of the FSPs selected for the CFSP fulfill criterion (a), (b), (c), (a)+(b), (a)+(c), (b)+(c) or (a)+(b)+(c) and most preferably at least 100% of the FSPs selected for the CFSP fulfill criterion (a), (b), (c), (a)+(b), (a)+(c), (b)+(c) or (a)+(b)+(c).

Regarding criterion (a) it is preferred that the FSP is encoded by a FSM that is observed with a CF observed for a subset of CS of a specific type of cancer that are part of the collection of M different CSs that is at least 5% for at least one or all of the cancer types present in the CS, preferably at least 10%, preferably at least 15%, preferably at least 20%, preferably at least 25%, preferably at least 30%, more preferably at least 35%, more preferably at least 40% for at least one or all of the cancer types present in the CS.

Regarding criterion (b) it is preferred that the average mRNA expression level of the gene with the FSM encoding the FSP is in the top $75^{th}$ percentile, preferably top $70^{th}$ percentile, preferably top $65^{th}$ percentile, preferably top $60^{th}$ percentile, preferably top $55^{th}$ percentile, more preferably top $50^{th}$ percentile, more preferably top $40^{th}$ percentile, more preferably top $30^{th}$ percentile of the distribution describing the average mRNA expression values of each protein-encoding gene across the CS, preferably of a specific type of cancer. The higher the relative abundance of the FSP the more likely the induction of an immune response is effective in treatment or prophylaxis of MSI cancers. Just for clarity the phrase "top $80^{th}$ percentile" refers to all FSMs that have an expression level within including the highest expressed mRNA and only excludes the lowest expressed 19% of the mRNAs. Accordingly, the "top $30^{th}$ percentile" refers to all FSMs that have an expression level including the highest expressed mRNA and excludes the lowest expressed 69% of the mRNAs.

Preferred combinations of criterions (a) and (b) are CF of at least 5% and mRNA expression level of the gene with the FSM is in the top $75^{th}$ percentile, preferably top $70^{th}$ percentile, preferably top $65^{th}$ percentile, preferably top $60^{th}$ percentile, preferably top $55^{th}$ percentile, more preferably top $50^{th}$ percentile, more preferably top $40^{th}$ percentile, more preferably top $30^{th}$ percentile of the distribution describing the average mRNA expression values of each protein-encoding gene across the CS, preferably of a specific type of cancer. Other preferred combinations of criterions (a) and (b) are CF of at least 10% and mRNA expression level of the gene with the FSM is in the top $75^{th}$ percentile, preferably top $70^{th}$ percentile, preferably top $65^{th}$ percentile, preferably top $60^{th}$ percentile, preferably top $55^{th}$ percentile, more preferably top $50^{th}$ percentile, more preferably top $40^{th}$ percentile, more preferably top $30^{th}$ percentile of the distribution describing the average mRNA expression values of each protein-encoding gene across the CS, preferably of a specific type of cancer. Other preferred combinations of criterions (a) and (b) are CF of at least 15% and mRNA expression level of the gene with the FSM is in the top $75^{th}$ percentile, preferably top $70^{th}$ percentile, preferably top $65^{th}$ percentile, preferably top $60^{th}$ percentile, preferably top $55^{th}$ percentile, more preferably top $50^{th}$ percentile, more preferably top $40^{th}$ percentile, more preferably top $30^{th}$ percentile of the distribution describing the average mRNA expression values of each protein-encoding gene across the CS, preferably of a specific type of cancer. Other preferred combinations of criterions (a) and (b) are CF of at least 20% and mRNA expression level of the gene with the FSM is in the top $75^{th}$ percentile, preferably top $70^{th}$ percentile, preferably top $65^{th}$ percentile, preferably top $60^{th}$ percentile, preferably top $55^{th}$ percentile, more preferably top $50^{th}$ percentile, more preferably top $40^{th}$ percentile, more preferably top $30^{th}$ percentile of the distribution describing the average mRNA expression values of each protein-encoding gene across the CS, preferably of a specific type of cancer.

Regarding criterion (c) it is preferred the FSM generating the FSP is observed in less than 2% in normal tissues in a cohort of subjects without a cancer, more preferably in less than 1.9%, less than 1.8%, less than 1.7%, less than 1.6%, less than 1.5%, less than 1.4%, less than 1.3%, less than 1.2%, less than 1.1%, less than 1.0% or less.

In a preferred embodiment of the method of the first aspect of the invention:
(i) the CS are derived from patients having a MSI tumor, preferably colorectal cancer and/or gastric cancer and/or endometrial cancer, more preferably colorectal cancer, gastric cancer and endometrial cancer; and/or
(ii) M is at least 30, preferably at least 50, more preferably at least 100, more preferably at least 200, most preferably at least 300; and/or
(iii) X is at least 50, preferably at least 100, more preferably at least 200, and more preferably at least 300.

Preferably, M is at least 30 and X is at least 50, preferably at least 100, more preferably at least 200, and more preferably at least 300, preferably, M is at least 50 and X is at least 50, preferably at least 100, more preferably at least 200, and more preferably at least 300, M is at least 100 and X is at least 50, preferably at least 100, more preferably at least 200, and more preferably at least 300, M is at least 200 and X is at least 50, preferably at least 100, more preferably at least 200, and more preferably at least 300, even more preferably M is at least 300 and X is at least 50, preferably at least 100, more preferably at least 200, and more preferably at least 300.

The increase of the sample number M ascertains a broader, i.e. more universal, applicability of the CVP. However, due to the statistic distribution of FSMs, the completeness of the determination of all FSMs occurring in a particular MSI cancer type will asymptotically reach a maximum for a given number of samples. Thus, no significant improvement will be obtained, when more than 400 samples of a particular MSI cancer type are included. To improve the broad coverage of the FSMs present in MSI cancer type it is preferred to use CS of two or more MSI cancers. Preferred MSI cancers which are amenable to treatment and prophylaxis at the same time are colorectal cancer, and gastric cancer, colorectal cancer and endometrial cancer, gastric cancer and endometrial cancer, and colorectal cancer, gastric cancer and endometrial cancer.

In a second aspect, the present invention relates to a method of determining the amino acid sequences of peptides comprised in a CVP or of the nucleic acid sequences encoding the peptides comprised in the CVP, comprising the steps of:
(a) selecting at least Y FSPs or antigenic fragments thereof from the CFSP selected according to the first aspect of the invention;
(b) modifying the amino acid sequence of one or more or of all of those FSPs which fulfill the following criteria: (i) the FSP has a length of between 4 to 9 amino acids, and/or (ii) the FSP contains one or more identical contiguous stretches of 8 or more amino acids present in more than one FSP encoded by the same FSM and/or (iii) the FSP contains one or more contiguous stretches of 8 or more amino acids also present in wt human proteins, wherein the amino acid sequence of a FSP according to (i) is modified by adding to the N-terminus of the FSP between 1, 2, 3, or 4, preferably 4 amino acids of the wild type (wt) amino acid sequence present immediately upstream of the FSP and wherein the modified FSP (mFSP) has a length of at least 8 amino acids; the amino acid sequence of a FSP according to (ii) is modified by removing these contiguous stretches from all but the longest FSP with the proviso that FSPs with a length of less than 4 amino acids after removal of the contiguous stretch are excluded from the CVP; and/or the amino acid sequence of a FSP according to (iii) is modified by removing these stretches; modified FSPs with a length of less than 4 amino acids after removal of the contiguous stretch are excluded from the CVP, and
wherein the amino acid sequences of the CVP comprises the amino acid sequences of the FSPs or antigenic fragments thereof selected in step a) and/or modified in step (b); and wherein Y is at least 20 more preferably at least 35.

In the context of the second aspect, it is noted that the term "determining" is used, as is immediately apparent from step (b), not in the sense of "identifying" the sequence of peptides (e.g. by sequencing), but in the sense of "defining", "fixing", "codifying" or "modifying".

In one embodiment, at least one of the FSPs modified in step (b) is, or is expected to be, i) immunogenic and ii) present in the patient tumor. Preferably, the immunogenicity of this FSP is not suppressed by another FSP selected or modified.

In a further embodiment, the FSPs modified in step (b) are candidate FSPs for producing a universal MSI CVP for prophylaxis or treatment of a patient with a cancer comprising hereditary and sporadic MSI cancer or being at risk of developing such a cancer.

The modification of FSPs according to step (b) serves the purpose to improve the antigenicity of the FSPs. It is preferred that at least 50% of the FSPs that fulfill criterions (i), (ii), (iii), (i)+(ii), (i)+(iii), (ii)+(iii), or (i)+(ii)+(iii) are modified, more preferably at least 60% of the FSPs that fulfill criterions (i), (ii), (iii), (i)+(ii), (i)+(iii), (ii)+(iii), or (i)+(ii)+(iii) are modified, at least 70% of the FSPs that fulfill criterions (i), (ii), (iii), (i)+(ii), (i)+(iii), (ii)+(iii), or (i)+(ii)+(iii) are modified, more preferably at least 80% of the FSPs that fulfill criterions (i), (ii), (iii), (i)+(ii), (i)+(iii), (ii)+(iii), or (i)+(ii)+(iii) are modified, more preferably at least 90% of the FSPs that fulfill criterions (i), (ii), (iii), (i)+(ii), (i)+(iii), (ii)+(iii), or (i)+(ii)+(iii) are modified, more preferably at least 95% of the FSPs that fulfill criterions (i), (ii), (iii), (i)+(ii), (i)+(iii), (ii)+(iii), or (i)+(ii)+(iii) are modified, and most preferably 100% of the FSPs that fulfill criterions (i), (ii), (iii), (i)+(ii), (i)+(iii), (ii)+(iii), or (i)+(ii)+(iii) are modified.

In a preferred embodiment of the second aspect of the present invention the selection of FSPs and mFSPs is carried out in step (a) in that the FSPs are successively selected from the CFSP and in each selection step a new FSP is selected from the CFSP that increases the cumulative amount of total FSP amino acid length (CAFSPL) to reach a threshold value in the maximal number of cancer samples which are below that threshold value and, optionally, if more than one FSP increases the CAFSPL for the maximal number of cancer samples for which the CAFSPL is still below the threshold value the FSP with the highest score is selected.

In a preferred embodiment of the second aspect of the present invention:
(i) the CAFSPL for each cancer sample is determined by summing up the amino acid length of the FSPs that are already part of the CVP and the new FSP from the CFSP for which the corresponding FSMs are present in the cancer sample; and/or
(ii) wherein the threshold value is defined separately for each subset of samples out of the CS that belong to a particular cancer type; and/or
(iii) wherein the score is defined as the product between the amino acid length of the FSP and the overall frequency with which the FSM generating the FSP is observed in the CS, optionally without counting the FSM in CS from a cancer type for which CF is below 5%, more preferably below 4%, more preferably below 3%, and/or
(iv) wherein the subset of cancer samples comprises all cancer samples from tumor types where the FSM is present with a CF greater than or equal to 5%, more preferably greater than or equal to 10% greater than or equal to 15%; and/or
(v) wherein FSPs generated by a FSM with an overall frequency lower than 5% more preferably below 4%, more preferably below 3% are excluded from the selection; and/or
(vi) wherein addition of new FSPs and/or modified FSPs proceeds until no further FSP is available whose inclusion in the CVP would increase the CAFSPL of any cancer sample whose CAFSPL is still below a threshold value (TV) or the cumulative length of all FSPs present in the CVP has reached a maximal value of V amino acids; and/or
(vii) wherein FSPs originating from the same FSM are treated as one FSP with a combined score calculated as the sum of the scores of the individual FSPs.

The criterions (i) to (vii) serve the purpose to improve the universality of the FSPs selected for the CVP by providing high immunogenic coverage to a cohort of patients with one or more types of MSI cancers. In addition criterion (vi) also allows to select a CVP that is practically feasible by limiting the total amount of antigens that can be encoded in the vaccine. The use of the scoring system ensures that FSPs with a higher observed frequency (therefore expected to be present in a large number of patients) and with a longer total amino acid length (i.e. FSPs with a higher overall immunogenic potential), are preferably included in the CVP.

In a preferred embodiment criterions (i)+(iii)+(vi) are fulfilled for at least 50%, more preferably at least 60%, at least 70%, at least 80%, at least 90%, at least 95% of the FSPs.

It is thus preferred that at least 50% FSPs are selected preferably based on criterions (i)+(iii)+(vi), more preferably based on criterions (i)+(ii)+(iii)+(vi), (i)+(iii)+(iv)+(vi), (i)+(iii)+(v)+(vi) or (i)+(iii)+(vi)+(vii), more preferably based on criterions (i)+(ii)+(iii)+(iv)+(vi), (i)+(ii)+(iii)+(v)+(vi), (i)+(ii)+(iii)+(vi)+(vii), (i)+(iii)+(iv)+(v)+(vi), (i)+(iii)+(iv)+(vi)+(vii) or (i)+(iii)+(v)+(vi)+(vii), more preferably based on criterions (i)+(ii)+(iii)+(iv)+(v)+(vi), (i)+(ii)+(iii)+(iv)+(vi)+(vii), (i)+(ii)+(iii)+(v)+(vi)+(vii) or (i)+(iii)+(iv)+(v)+(vi)+(vii), most preferably based on criterions (i)+(ii)+(iii)+(iv)+(v)+(vi)+(vii), more preferably at least 60% FSPs are selected preferably based on criterions (i)+(iii)+(vi), more preferably based on criterions (i)+(ii)+(iii)+(vi), (i)+(iii)+(iv)+(vi), (i)+(iii)+(v)+(vi) or (i)+(iii)+(vi)+(vii), more preferably based on criterions (i)+(ii)+(iii)+(iv)+(vi), (i)+(ii)+(iii)+(v)+(vi), (i)+(ii)+(iii)+(vi)+(vii), (i)+(iii)+(iv)+(v)+(vi), (i)+(iii)+(iv)+(vi)+(vii) or (i)+(iii)+(v)+(vi)+(vii), more preferably based on criterions (i)+(ii)+(iii)+(iv)+(v)+(vi), (i)+(ii)+(iii)+(iv)+(vi)+(vii), (i)+(ii)+(iii)+(v)+(vi)+(vii) or (i)+(iii)+(iv)+(v)+(vi)+(vii), most preferably based on criterions (i)+(ii)+(iii)+(iv)+(v)+(vi)+(vii), more preferably at least 70% FSPs are selected preferably based on criterions (i)+(iii)+(vi), more preferably based on criterions (i)+(ii)+(iii)+(vi), (i)+(iii)+(iv)+(vi), (i)+(iii)+(v)+(vi) or (i)+(iii)+(vi)+(vii), more preferably based on criterions (i)+(ii)+(iii)+(iv)+(vi), (i)+(ii)+(iii)+(v)+(vi), (i)+(ii)+(iii)+(vi)+(vii), (i)+(iii)+(iv)+(v)+(vi), (i)+(iii)+(iv)+(vi)+(vii) or (i)+(iii)+(v)+(vi)+(vii), more preferably based on criterions(i)+(ii)+(iii)+(iv)+(v)+(vi), (i)+(ii)+(iii)+(iv)+(vi)+(vii), (i)+(ii)+(iii)+(v)+(vi)+(vii) or (i)+(iii)+(iv)+(v)+(vi)+(vii), most preferably based on criterions(i)+(ii)+(iii)+(iv)+(v)+(vi)+(vii), more preferably at least 80% FSPs are selected preferably based on criterions (i)+(iii)+(vi), more preferably based on criterions (i)+(ii)+(iii)+(vi), (i)+(iii)+(iv)+(vi), (i)+(iii)+(v)+(vi) or (i)+(iii)+(vi)+(vii), more preferably based on criterions (i)+(ii)+(iii)+(iv)+(vi), (i)+(ii)+(iii)+(v)+(vi), (i)+(ii)+(iii)+(vi)+(vii), (i)+(iii)+(iv)+(v)+(vi), (i)+(iii)+(iv)+(vi)+(vii) or (i)+(iii)+(v)+(vi)+(vii), more preferably based on criterions (i)+(ii)+(iii)+(iv)+(v)+(vi), (i)+(ii)+(iii)+(iv)+(vi)+(vii), (i)+(ii)+(iii)+(v)+(vi)+(vii) or (i)+(iii)+(iv)+(v)+(vi)+(vii), most preferably based on criterions (i)+(ii)+(iii)+(iv)+(v)+(vi)+(vii), more preferably at least 90% FSPs are selected preferably based on criterions (i)+(iii)+(vi), more preferably based on criterions (i)+(ii)+(iii)+(vi), (i)+(iii)+(iv)+(vi), (i)+(iii)+(v)+(vi) or (i)+(iii)+(vi)+(vii), more preferably based on criterions (i)+(ii)+(iii)+(iv)+(vi), (i)+(ii)+(iii)+(v)+(vi), (i)+(ii)+(iii)+(vi)+(vii), (i)+(iii)+(iv)+(v)+(vi), (i)+(iii)+(iv)+(vi)+(vii) or (i)+(iii)+(v)+(vi)+(vii), more preferably based on criterions (i)+(ii)+(iii)+(iv)+(v)+(vi), (i)+(ii)+(iii)+(iv)+(vi)+(vii), (i)+(ii)+(iii)+(v)+(vi)+(vii) or (i)+(iii)+(iv)+(v)+(vi)+(vii), most preferably based on criterions (i)+(ii)+(iii)+(iv)+(v)+(vi)+(vii), and most preferably 100% FSPs are selected preferably based on criterions (i)+(iii)+(vi), more preferably based on criterions (i)+(ii)+(iii)+(vi), (i)+(iii)+(iv)+(vi), (i)+(iii)+(v)+(vi) or (i)+(iii)+(vi)+(vii), more preferably based on criterions (i)+(ii)+(iii)+(iv)+(vi), (i)+(ii)+(iii)+(v)+(vi), (i)+(ii)+(iii)+(vi)+

(vii), (i)+(iii)+(iv)+(v)+(vi), (i)+(iii)+(iv)+(vi)+(vii) or (i)+(iii)+(v)+(vi)+(vii), more preferably based on criterions (i)+(ii)+(iii)+(iv)+(v)+(vi), (i)+(ii)+(iii)+(iv)+(vi)+(vii), (i)+(ii)+(iii)+(v)+(vi)+(vii) or (i)+(iii)+(iv)+(v)+(vi)+(vii), most preferably based on criterions (i)+(ii)+(iii)+(iv)+(v)+(vi)+(vii).

It is immediately apparent to the skilled person that the score can also be defined in alternative ways, for example based only on the overall frequency of the FSM generating the FSP, the length or the reciprocal length of the FSP or as the sum of cancer-specific scores, or after excluding one or more cancer types from the calculation of the score. An alternative score may further include or be exclusively based on the number of predicted MHC class I and/or class II epitopes within each FSP. It is also immediately apparent to the skilled person that criterion (vii) might be modified if the expression levels of the specific mRNA isoforms comprising the FSM are known. In that case, one or more of the FSPs generated by the same FSM could be excluded from the selection or the score of the FSPs arising from the individual mRNA isoforms comprising the FSM can be weighted according to the observed relative expression levels of the isoforms.

In a preferred embodiment of the second aspect of the present invention:
(i) addition of new FSPs proceeds until no further FSP is available whose inclusion in the CVP would increase the CAFSPL of any cancer sample whose CAFSPL is still below TV; and/or
(ii) FSPs originating from the same FSM are treated as one FSP with a combined score calculated as the sum of the scores of the individual FSPs.

In a preferred embodiment of the second aspect of the present invention
(a) the TV is at least 400 amino acids, preferably at least 600 amino acids, more preferably at least 800 amino acids; or
(b) the TV is:
  (i) at least 400 amino acids, preferably at least 600 amino acids, more preferably at least 800 amino acids for colorectal and gastric cancer; and
  (ii) at least 200 amino acids, preferably at least 300 amino acids, more preferably at least 400 amino acids for endometrial cancer.

It is immediately clear to the skilled person that the values of TV can be extended to any situation where the selection is performed on a CS that includes different types of cancers, e.g. combinations of samples from colorectal cancer, gastric cancer, endometrial cancer, small intestine cancer, hepatobiliary tract cancer, liver cancer, neuroendocrine cancers, cervical cancer, ovarian cancer, uterine sarcomas, brain cancer and/or skin cancer.

In a preferred embodiment of the second aspect of the present invention:
(i) the CVP comprises at least 4 amino acids of each FSP selected from the CFSP; and/or
(ii) Y is selected in such that the cumulative amino acid length V of all peptides that are part of the CVP is at least 280 amino acids, preferably at least 6000;
(iii) Y is at least 35, preferably at least 50, preferably at least 100, more preferably at least 200, and/or
(iv) the CVP comprises FSPs and/or mFSPs selected from the group of FSPs and/or mFSPs according to SEQ ID NO: 1 to 1087, preferably selected from the group of FSPs and/or mFSPs according to SEQ ID NO: 1 to 209.

In a third aspect, the present invention relates to a method of producing a CVP or a collection of nucleic acids encoding the CVP comprising the steps of (i) obtaining the amino acid or nucleic acid sequence information determined in the method of the second aspect of the invention; and
(ii) synthesizing the amino acid sequence of the CVP in one or more polypeptides or a collection of nucleic acids with that sequence and optionally inserting the collection of nucleic acids into one or more expression cassettes and/or a collection of expression vectors.

The synthesizing of the FSPs and, if modified the mFSPs, or antigenic fragments thereof of the CVP may be carried out by recombinant expression of a collection of nucleic acids encoding the FSPs and, if modified the mFSPs or antigenic fragments thereof or by chemical synthesis. Similarly, the synthesis of the collection of nucleic acids encoding the peptides of the CVP can be carried out by known methods including chemical synthesis on a solid phase.

In a fourth aspect, the present invention relates to a CVP producible by the method of the second aspect of the invention or a collection of nucleic acids encoding the peptides of said CVP.

In a fifth aspect, the CVP comprises or consists of Y different FSPs and/or mFSPs or antigenic fragment of the FSP and/or mFSP with a length of at least 8 amino acids, wherein each FSP or the FSPs which are modified to mFSP is the complete translation product of the protein-encoding segment of a FSM containing nucleic acid starting from the codon encoding the first amino acid that is different relative to the translation of the corresponding wt nucleic acid without the FSM of in either case at least 4 amino acid length and wherein at least 50% of the FSPs or the FSPs which are modified to mFSPs fulfill one or more of the following criteria:
(a) the FSP is encoded by a FSM that is observed with a cancer type specific frequency (CF) observed for a subset of CS of a specific type of cancer that are part of a collection of M different CS s that is at least 5% for at least one of the cancer types present in the CS; and/or
(b) the average mRNA expression level of the gene with the FSM encoding the FSP is in the top $80^{th}$ percentile of the distribution describing the average mRNA expression values of each protein-encoding gene across the CS; and/or
(c) the FSM generating the FSP is observed in less than 2% in normal tissues in a cohort of subjects without a cancer wherein the amino acid sequence of one or more or all those FSPs which fulfill the following criteria: (i) the FSP encoded by a nucleic acid comprising a FSM starting from the amino acid encoded by the FC has a length between 4 to 9 amino acids, and/or (ii) the FSP contains one or more identical contiguous stretches of 8 or more amino acids present in more than one FSP encoded by the same FSM and/or (iii) the FSP contains one or more contiguous stretches of 8 or more amino acids also present in wt human proteins, are modified for a FSP according to (i) by adding to the N-terminus of the FSP between 1 to 4 amino acids of the wild type (wt) amino acid sequence present immediately upstream of the FSP and wherein the modified FSP (mFSP) has a length of at least 8 amino acids; for a FSP according to (ii) is modified by removing these contiguous stretches from all but the longest FSP with the proviso that FSPs with a length of less than 4 amino acids after removal of the contiguous stretch are excluded from the CVP; and/or for a FSP according to (iii) is modified by removing these stretches; modified FSPs with a length of less than 4 amino acids after removal of the contiguous stretch are excluded from the CVP;

and wherein Y is at least 20 more preferably at least 35 and M is at least 5.

Preferably, at least 50% of the FSPs included in the CVP fulfill criterion (a), (b), (c), (a)+(b), (a)+(c), (b)+(c) or (a)+(b)+(c). It is preferred that 60% of the FSPs selected for the CFSP fulfill criterion (a), (b), (c), (a)+(b), (a)+(c), (b)+(c) or (a)+(b)+(c), more preferably at least 70% of the FSPs selected for the CFSP fulfill criterion (a), (b), (c), (a)+(b), (a)+(c), (b)+(c) or (a)+(b)+(c), more preferably at least 80% of the FSPs selected for the CFSP fulfill criterion (a), (b), (c), (a)+(b), (a)+(c), (b)+(c) or (a)+(b)+(c), more preferably at least 90% of the FSPs selected for the CFSP fulfill criterion (a), (b), (c), (a)+(b), (a)+(c), (b)+(c) or (a)+(b)+(c), more preferably at least 95% of the FSPs selected for the CFSP fulfill criterion (a), (b), (c), (a)+(b), (a)+(c), (b)+(c) or (a)+(b)+(c) and most preferably at least 100% of the FSPs selected for the CFSP fulfill criterion (a), (b), (c), (a)+(b), (a)+(c), (b)+(c) or (a)+(b)+(c).

Regarding criterion (a) it is preferred that the FSP is encoded by a FSM that is observed with a CF observed for a subset of CS of a specific type of cancer that are part of the collection of M different CSs that is at least 10% for at least one or all of the cancer types present in the CS, preferably at least 15%, preferably at least 20%, preferably at least 25%, preferably at least 30%, more preferably at least 35%, more preferably at least 40% for at least one or all of the cancer types present in the CS.

Regarding criterion (b) it is preferred that the average mRNA expression level of the gene with the FSM encoding the FSP is in the top $75^{th}$ percentile, preferably top $70^{th}$ percentile, preferably top $65^{th}$ percentile, preferably top $60^{th}$ percentile, preferably top $55^{th}$ percentile, more preferably top $50^{th}$ percentile, more preferably top $40^{th}$ percentile, more preferably top $30^{th}$ percentile of the distribution describing the average mRNA expression values of each protein-encoding gene across the CS. The higher the relative abundance of the FSP the more likely the induction of an immune response is effective in treatment or prophylaxis of MSI cancers. Just for clarity the phrase "top $80^{th}$ percentile" refers to all FSMs that have an expression level within including the highest expressed mRNA and only excludes the lowest expressed 19% of the mRNAs. Accordingly, the "top $30^{th}$ percentile" refers to all FSMs that have an expression level including the highest expressed mRNA and excludes the lowest expressed 69% of the mRNAs.

Preferred combinations of criterions (a) and (b) are CF of at least 5% and mRNA expression level of the gene with the FSM is in the top $75^{th}$ percentile, preferably top $70^{th}$ percentile, preferably top $65^{th}$ percentile, preferably top $60^{th}$ percentile, preferably top $55^{th}$ percentile, more preferably top $50^{th}$ percentile, more preferably top $40^{th}$ percentile, more preferably top $30^{th}$ percentile of the distribution describing the average mRNA expression values of each protein-encoding gene across the CS, preferably of a specific type of cancer. Other preferred combinations of criterions (a) and (b) are CF of at least 10% and mRNA expression level of the gene with the FSM is in the top $75^{th}$ percentile, preferably top $70^{th}$ percentile, preferably top $65^{th}$ percentile, preferably top $60^{th}$ percentile, preferably top $55^{th}$ percentile, more preferably top $50^{th}$ percentile, more preferably top $40^{th}$ percentile, more preferably top $30^{th}$ percentile of the distribution describing the average mRNA expression values of each protein-encoding gene across the CS, preferably of a specific type of cancer. Other preferred combinations of criterions (a) and (b) are CF of at least 15% and mRNA expression level of the gene with the FSM is in the top $75^{th}$ percentile, preferably top $70^{th}$ percentile, preferably top $65^{th}$ percentile, preferably top $60^{th}$ percentile, preferably top $55^{th}$ percentile, more preferably top $50^{th}$ percentile, more preferably top $40^{th}$ percentile, more preferably top $30^{th}$ percentile of the distribution describing the average mRNA expression values of each protein-encoding gene across the CS, preferably of a specific type of cancer. Other preferred combinations of criterions (a) and (b) are CF of at least 20% and mRNA expression level of the gene with the FSM is in the top $75^{th}$ percentile, preferably top $70^{th}$ percentile, preferably top $65^{th}$ percentile, preferably top $60^{th}$ percentile, preferably top $55^{th}$ percentile, more preferably top $50^{th}$ percentile, more preferably top $40^{th}$ percentile, more preferably top $30^{th}$ percentile of the distribution describing the average mRNA expression values of each protein-encoding gene across the CS, preferably of a specific type of cancer.

Regarding criterion (c) it is preferred the FSM generating the FSP is observed in less than 2% in normal tissues in a cohort of subjects without a cancer, more preferably in less than 1.9%, less than 1.8%, less than 1.7%, less than 1.6%, less than 1.5%, less than 1.4%, less than 1.3%, less than 1.2%, less than 1.1%, less than 1.0% or less.

In a preferred embodiment the CVP of the fifth aspect of the present invention:
(i) the CS are derived from patients having a MSI tumor, preferably colorectal cancer and/or gastric cancer and/or endometrial cancer, more preferably colorectal cancer, gastric cancer and endometrial cancer; and/or
(ii) M is at least 10, preferably at least 20, preferably at least 30, preferably at least 50, more preferably at least 100, more preferably at least 200, most preferably at least 300; and/or
(iii) Y is at least 35, preferably at least 50, preferably at least 100, more preferably at least 200; and/or
(iv) the CVP comprises at least 4 preferably at least 6, more preferably at least 8 amino acids of each FSP; and/or
(v) Y is selected in such that the cumulative amino acid length V of all FSPs and/or mFSPs or antigenic fragments thereof that are part of the CVP is at least 280 amino acids, preferably at least 500 amino acids, preferably at least 1.000 amino acids, preferably at least 1.500 amino acids, preferably at least 2.000 amino acids, preferably at least 2.500 amino acids, preferably at least 3.000 amino acids preferably at least 3.500 amino acids, preferably at least 4.000 amino acids, preferably at least 4.500 amino acids, preferably at least 5.000 amino acids, preferably at least 5.500 amino acids, more preferably at least 6000; and/or
(vi) the FSPs and/or mFSPs of the CVP are selected from the group of FSPs and/or mFSPs according to SEQ ID NO: 1 to 1087, preferably selected from the group of FSPs and/or mFSPs according to SEQ ID NO: 1 to 209.

Preferably, M is at least 30 and Y is at least 50, preferably at least 100, more preferably at least 200, and more preferably at least 300, preferably, M is at least 50 and Y is at least 50, preferably at least 100, more preferably at least 200, and more preferably at least 300, M is at least 100 and Y is at least 50, preferably at least 100, more preferably at least 200, and more preferably at least 300, M is at least 200 and Y is at least 50, preferably at least 100, more preferably at least 200, and more preferably at least 300, even more preferably M is at least 300 and Y is at least 50, preferably at least 100, more preferably at least 200, and more preferably at least 300.

In one embodiment of the present invention the CVP of the fifth aspect of the invention further comprises one or more non-MSI cancer specific antigens. Preferably, such antigens are specific also to one or more of the cancer types to be treated.

In a preferred embodiment at least 35, preferably at least 50, preferably at least 100, more preferably at least 200, more preferably at least 209 FSPs and/or mFSPs or antigenic fragments thereof of the CVP are selected from the group of FSPs and/or mFSPs according to SEQ ID NO: 1 to 1087, preferably selected from the group of FSPs and/or mFSPs according to SEQ ID NO: 1 to 209.

The FSPs and mFSPs according to SEQ ID NO: 1 to 1087 are ordered from 1 to 1087 in decreasing order of relevance for prophylaxis or treatment of MSI tumors, in particular of colorectal carcinoma, gastric cancer and endometrial cancer. Particular suitable subsets comprise or consist of FSPs and mFSPs with the amino acid sequences of SEQ ID NO: 1 to 50, 1 to 75, 1 to 100, 1 to 125, 1 to 150, 1 to 175, 1 to 200, particularly preferably of 1 to 209, 1 to 225, 1 to 250, 1 to 275, 1 to 300, 1 to 325, 1 to 350 1 to 375, 1 to 400, 1 to 450, 1 to 500, 1 to 550, 1 to 600, 1, to 650, 1 to 700, 1 to 750, 1 to 800, 1 to 850, 1 to 900, 1 to 950, 1 to 1000, 1 to 1050 or 1 to 1087. While it is preferred that the subset comprise or consists of exactly the respectively indicated FSPs and/or mFSPs, it is understood by the skilled person that between 1 to 10% of these FSPs and/or mFSPs may be omitted from the set without any substantial loss in its activity. Similarly, and as implied by the "comprising" language a subset that comprises, e.g. the amino acid sequences of SEQ ID NO: 1 to 200 may additionally comprise 1 to 100 or more FSPs or mFSP of SEQ ID NO: 201 to 1087 and/or one or more other FSP or mFSP or a non-MSI cancer specific antigen.

In a preferred embodiment the CVP of the fifth aspect of the present invention the FSPs of the CVP have been successively selected from a CFSP and wherein in each selection step a new FSP or antigenic fragment thereof is selected from the CFSP to increase the CAFSPL to reach a threshold value in the maximal number of cancer samples which are below that threshold value and optionally, if more than one FSP increases the CAFSPL for the maximal number of cancer samples for which the CAFSPL is still below the threshold value, the FSP with the highest score is selected.

In a preferred embodiment the CVP of the fifth aspect of the present invention:

(i) the CAFSPL for each cancer sample is determined by summing up the amino acid length of the FSPs that are already part of the CVP and the new FSP from the CFSPP for which the corresponding FSMs are present in the cancer sample; and/or (ii) the threshold value is defined separately for each subset of samples out of the CS that belong to a particular cancer type; and/or (iii) the score is defined as the product between the amino acid length of the FSP and the overall frequency with which the FSM generating the FSP is observed in the CS; and/or (iv) addition of new FSPs proceeds until no further FSP is available whose inclusion in the CVP would increase the CAFSPL of any cancer sample whose CAFSPL is still below a threshold value (TV); and/or (v) wherein FSPs originating from the same FSM are treated as one FSP with a combined score calculated as the sum of the scores of the individual FSPs.

In a preferred embodiment the CVP of the fifth aspect of the present invention, (i) wherein the CAFSPL for each cancer sample is determined by summing up the amino acid length of the FSPs that are already part of the CVP and the new FSP from the CFSP for the corresponding FSM are present in the cancer sample; and/or (ii) wherein the threshold value is defined separately for each subset of samples out of the CS that belong to a particular cancer type; and/or (iii) wherein the score is defined as the product between the amino acid length of the FSP and the overall frequency of the FSM generating the FSP without counting the FSM in cancer samples from a cancer type for which CF is below 5%, more preferably below 4% and more preferably below 3%; and/or (iv) wherein the subset of cancer samples comprises all cancer samples from tumor types where the FSM is present with a CF greater than or equal to 5%, more preferably greater than or equal to 10% greater than or equal to 15%; and/or (v) wherein FSPs generated by a FSM with an overall frequency lower than 5% more preferably below 4% and more preferably below 3% are excluded from the selection; and/or (vi) wherein addition of new FSPs proceeds until no further FSP is available whose inclusion in the CVP would increase the CAFSPL of any cancer sample whose CAFSPL is still below a TV or the cumulative length of all FSPs present in the CVP has reached a maximal value of V amino acids; and/or (vii) and wherein FSPs originating from the same FSM are treated as one FSP with a combined score calculated as the sum of the scores of the individual FSPs.

It is understood by the skilled person that the CVP according to the fifth aspect may be designed by the method of the first and second aspect and accordingly the selection steps and criteria outlined regarding the first and second aspect may equally be used to characterize the CVP of the fifth aspect. Accordingly, in a preferred embodiment criterions (i)+(iii)+(vi) are fulfilled for at least 50%, more preferably at least 60%, at least 70%, at least 80%, at least 90%, at least 95% of the FSPs.

It is thus preferred that at least 50% FSPs are selected preferably based on criterions (i)+(iii)+(vi), more preferably based on criterions (i)+(ii)+(iii)+(vi), (i)+(iii)+(iv)+(vi), (i)+(iii)+(v)+(vi) or (i)+(iii)+(vi)+(vii), more preferably based on criterions (i)+(ii)+(iii)+(iv)+(vi), (i)+(ii)+(iii)+(v)+(vi), (i)+(ii)+(iii)+(vi)+(vii), (i)+(iii)+(iv)+(v)+(vi), (i)+(iii)+(iv)+(vi)+(vii) or (i)+(iii)+(v)+(vi)+(vii), more preferably based on criterions (i)+(ii)+(iii)+(iv)+(v)+(vi), (i)+(ii)+(iii)+(iv)+(vi)+(vii), (i)+(ii)+(iii)+(v)+(vi)+(vii) or (i)+(iii)+(iv)+(v)+(vi)+(vii), most preferably based on criterions (i)+(ii)+(iii)+(iv)+(v)+(vi)+(vii), more preferably at least 60% FSPs are selected preferably based on criterions (i)+(iii)+(vi), more preferably based on criterions (i)+(ii)+(iii)+(vi), (i)+(iii)+(iv)+(vi), (i)+(iii)+(v)+(vi) or (i)+(iii)+(vi)+(vii), more preferably based on criterions (i)+(ii)+(iii)+(iv)+(vi), (i)+(ii)+(iii)+(v)+(vi), (i)+(ii)+(iii)+(vi)+(vii), (i)+(iii)+(iv)+(v)+(vi), (i)+(iii)+(iv)+(vi)+(vii) or (i)+(iii)+(v)+(vi)+(vii), more preferably based on criterions (i)+(ii)+(iii)+(iv)+(v)+(vi), (i)+(ii)+(iii)+(iv)+(vi)+(vii), (i)+(ii)+(iii)+(v)+(vi)+(vii) or (i)+(iii)+(iv)+(v)+(vi)+(vii), most preferably based on criterions (i)+(ii)+(iii)+(iv)+(v)+(vi)+(vii), more preferably at least 70% FSPs are selected preferably based on criterions (i)+(iii)+(vi), more preferably based on criterions (i)+(ii)+(iii)+(vi), (i)+(iii)+(iv)+(vi), (i)+(iii)+(v)+(vi) or (i)+(iii)+(vi)+(vii), more preferably based on criterions (i)+(ii)+(iii)+(iv)+(vi), (i)+(ii)+(iii)+(v)+(vi), (i)+(ii)+(iii)+(vi)+(vii), (i)+(iii)+(iv)+(v)+(vi), (i)+(iii)+(iv)+(vi)+(vii) or (i)+(iii)+(v)+(vi)+(vii), more preferably based on criterions (i)+(ii)+(iii)+(iv)+(v)+(vi), (i)+(ii)+(iii)+(iv)+(vi)+(vii), (i)+(ii)+(iii)+(v)+(vi)+(vii) or (i)+(iii)+(iv)+(v)+(vi)+(vii), most preferably based on criterions (i)+(ii)+(iii)+(iv)+(v)+(vi)+

(vii), more preferably at least 80% FSPs are selected preferably based on criterions (i)+(iii)+(vi), more preferably based on criterions (i)+(ii)+(iii)+(vi), (i)+(iii)+(iv)+(vi), (i)+(iii)+(v)+(vi) or (i)+(iii)+(vi)+(vii), more preferably based on criterions (i)+(ii)+(iii)+(iv)+(vi), (i)+(ii)+(iii)+(v)+(vi), (i)+(ii)+(iii)+(vi)+(vii), (i)+(iii)+(iv)+(v)+(vi), (i)+(iii)+(iv)+(vi)+(vii) or (i)+(iii)+(v)+(vi)+(vii), more preferably based on criterions (i)+(ii)+(iii)+(iv)+(v)+(vi), (i)+(ii)+(iii)+(iv)+(vi)+(vii), (i)+(ii)+(iii)+(v)+(vi)+(vii) or (i)+(iii)+(iv)+(v)+(vi)+(vii), most preferably based on criterions (i)+(ii)+(iii)+(iv)+(v)+(vi)+(vii), more preferably at least 90% FSPs are selected preferably based on criterions (i)+(iii)+(vi), more preferably based on criterions (i)+(ii)+(iii)+(vi), (i)+(iii)+(iv)+(vi), (i)+(iii)+(v)+(vi) or (i)+(iii)+(vi)+(vii), more preferably based on criterions (i)+(ii)+(iii)+(iv)+(vi), (i)+(ii)+(iii)+(v)+(vi), (i)+(ii)+(iii)+(vi)+(vii), (i)+(iii)+(iv)+(v)+(vi), (i)+(iii)+(iv)+(vi)+(vii) or (i)+(iii)+(v)+(vi)+(vii), more preferably based on criterions (i)+(ii)+(iii)+(iv)+(v)+(vi), (i)+(ii)+(iii)+(iv)+(vi)+(vii), (i)+(ii)+(iii)+(v)+(vi)+(vii) or (i)+(iii)+(iv)+(v)+(vi)+(vii), most preferably based on criterions (i)+(ii)+(iii)+(iv)+(v)+(vi)+(vii), and most preferably 100% FSPs are selected preferably based on criterions (i)+(iii)+(vi), more preferably based on criterions (i)+(ii)+(iii)+(vi), (i)+(iii)+(iv)+(vi), (i)+(iii)+(v)+(vi) or (i)+(iii)+(vi)+(vii), more preferably based on criterions (i)+(ii)+(iii)+(iv)+(vi), (i)+(ii)+(iii)+(v)+(vi), (i)+(ii)+(iii)+(vi)+(vii), (i)+(iii)+(iv)+(v)+(vi), (i)+(iii)+(iv)+(vi)+(vii) or (i)+(iii)+(v)+(vi)+(vii), more preferably based on criterions (i)+(ii)+(iii)+(iv)+(v)+(vi), (i)+(ii)+(iii)+(iv)+(vi)+(vii), (i)+(ii)+(iii)+(v)+(vi)+(vii) or (i)+(iii)+(iv)+(v)+(vi)+(vii), most preferably based on criterions (i)+(ii)+(iii)+(iv)+(v)+(vi)+(vii).

In a preferred embodiment the CVP of the fifth aspect of the present invention the TV is:

(a) the TV is at least 400 amino acids, preferably at least 600 amino acids, more preferably at least 800 amino acids; or (b) the TV is:

(i) at least 400 amino acids, preferably at least 600 amino acids, more preferably at least 800 amino acids for colorectal and gastric cancer; and (ii) at least 200 amino acids, preferably at least 300 amino acids, more preferably at least 400 amino acids for endometrial cancer.

In a preferred embodiment the CVP of the fifth aspect of the present invention the peptides of the CVP are separate or at least two FSPs and/or mFSPs are comprised in one or more polypeptides. When linking two or more FSPs and/or mFSPs to a polypeptide it is preferred that the linkage is direct with a peptide bond, i.e. without an amino acid linker.

It is also preferred that it is assessed before linking two FSPs and/or mFSPs within a polypeptide whether the resulting junction sequence contains one or more contiguous stretches of 8 or more amino acids also present in wt human proteins. If that is the case those two peptides are not linked in this way. Accordingly, the resulting polypeptide of linked FSPs and/or mFSPs will not contain one or more contiguous stretches of 8 or more amino acids also present in wt human proteins. Depending on the total length of the FSPs and/or mFSPs comprised in the CVP the FSPs and/or mFSPs may be comprised in two, three, four, five, six or more polypeptides.

The present inventors have assembled the 209 FSPs and mFSPs of SEQ ID NO: 1 to 209 or antigenic fragments thereof in four polypeptides and have found that this a particularly suitable way of providing these antigens. Preferred arrangements of the FSPs and mFSPs of SEQ ID NO: 1 to 209 in four polypeptides consists of or comprises the following four polypeptides with amino acid sequences according to SEQ ID NO: 1088 to 1091 (layout A), SEQ ID NO: 1092 to 1095 (layout B), SEQ ID NO: 1155 to 1158 (layout C) or SEQ ID NO: 1159 to 1162 (layout D).

It is preferred that in subsequent rounds of administration of the same CVP, i.e. comprising the same FSPs and mFSPs, the polypeptides comprising the FSPs and mFSPs, e.g. according to SEQ ID NO: 1 to 209, are arranged in different order. This minimizes unwanted immune reactions again junctional epitopes. For example, it is preferred to combine administration of the CVP in polypeptide layout A with polypeptide layout B, layout A with layout C, layout A with layout D, layout B with layout C, layout B with layout D, layout C with layout D, layout A with layout B and layout C, layout A with layout B and layout D, layout B with layout C and layout D, layout A with layout B, layout C and layout D.

Accordingly, the present invention also comprises 2, 3, 4, 5, 6, or more different layouts of polypeptides, wherein each set comprises one or more, preferably 2, 3, 4, 5, 6, 7, 8, 9, or 10 or more polypeptides comprising or consisting of the same FSPs and mFSPs or antigenic fragments thereof, i.e. are the same CVP. The difference between each set is thus not the amino acid sequence of the FSPs, mFSPs or antigenic fragments thereof, but the arrangement of the FSPs, mFSPs or antigenic fragments thereof in the respective number of polypeptides. It is particularly, preferred that a given CVP is provided in two different layouts and comprises one or more, preferably 2, 3, 4, 5, 6, 7, 8, 9, or 10 or more polypeptides, most preferably 4 polypeptides comprising or consisting of the same FSPs and mFSPs or antigenic fragments thereof, three different layouts and comprises one or more, preferably 2, 3, 4, 5, 6, 7, 8, 9, or 10 or more polypeptides, most preferably 4 polypeptides comprising or consisting of the same FSPs and mFSPs or antigenic fragments thereof, four different layouts and comprises one or more, preferably 2, 3, 4, 5, 6, 7, 8, 9, or 10 or more polypeptides, most preferably 4 polypeptides comprising or consisting of the same FSPs and mFSPs or antigenic fragments thereof, five different layouts and comprises one or more, preferably 2, 3, 4, 5, 6, 7, 8, 9, or 10 or more polypeptides, most preferably 4 polypeptides comprising or consisting of the same FSPs and mFSPs or antigenic fragments thereof. Preferably, each different layout is distinguished from the other layouts by different junction sequences, i.e. two layouts do not comprise a link between the same N- to C-terminal link of one FSP or mFSP to the next FSP or mFSP.

Each layout will typically be administered separately to a patient and, thus, the different layouts can also be viewed as separate compositions of the same CVP.

In a preferred embodiment the CVP of the fifth aspect of the present invention one or more FSPs and/or mFSPs or polypeptides comprising two or more FSPs and/or mFSPs of the CVP are linked, preferably by peptide bonds, to one or more of the following elements that enhance immunogenicity of the CVP: an invariant chain sequence or fragment thereof; a tissue-type plasminogen activator; a PEST sequence; a cyclin destruction box; an ubiquitination signal; a SUMOylation signal; an Interleukin, preferably an Interleukin 2, Interleukin 12, or Interleukin 15; a checkpoint protein specific ligand, preferably an anti-PD1 antibody or PD1-binding fragment thereof, an anti-CTLA4 antibody or an anti-CTLA4-binding fragment thereof, an anti-LAGS antibody or an anti-LAGS-binding fragment, an anti-TIM3 antibody or an anti-TIM3-binding fragment thereof.

In a preferred embodiment a sorting signal (either the human tissue plasminogen activator signal peptide (hTPA; SEQ ID NO: 1104 or a functional fragment thereof that is sorted as the hTPA) or the human invariant chain (hINV; SEQ ID NO: 1105 or a functional fragment thereof that is sorted as the hINV) is added at the N-terminus and, optionally an influenza HA-tag sequence (SEQ ID NO: 1106) at the C-terminus of the polypeptides of SEQ ID NO: 1088 to 1091 (layout A), SEQ ID NO: 1092 to 1095 (layout B), SEQ ID NO: 1155 to 1158 (layout C) or SEQ ID NO: 1159 to 1162 (layout D).

Preferred amino acid sequence of so constructed polypeptides are provided as SEQ ID NO: 1107 to 1110 (layout A), SEQ ID NO: 1111 to 1114 (layout B), SEQ ID NO: 1171 to 1174 (layout C) and SEQ ID NO: 1179 to 1182 (layout D) for hTPA and by SEQ ID NO: 1115 to 1118 (layout A), SEQ ID NO: 1119 to 1122 (layout B), SEQ ID NO: 1175 to 1178 (layout C) and SEQ ID NO: 1183 to 1186 (layout D) for hINV.

In a sixth aspect, the present invention relates to a collection of nucleic acids encoding the CVP of the fifth aspect of the present invention. The nucleic acid may preferably be DNA, RNA or RNA modified to increase its serum half-life.

For the reasons set out above regarding the CVP it is preferred to use 2, 3, 4, 5, 6, 7, 8, 9, 10 or more, preferably 4 different layouts of the 1, 2, 3, 4, 5, 6, 7, 8, 9, or 10 or more polypeptides comprising the FSPs, mFPS or antigenic fragments thereof. Consistently, the collection of nucleic acids encoding the respective number of polypeptides have different layouts. In a preferred embodiment the collection of nucleic acids encoding the FSB and/or mFSB encode the four polypeptides according to SEQ ID NO: 1088 to 1091 (layout A), SEQ ID NO: 1092 to 1095 (layout B), SEQ ID NO: 1155 to 1158 (layout C) or SEQ ID NO: 1159 to 1162 (layout D) and are codon-optimized based on human codon usage.

When a CVP is administered in the form of a collection of nucleic acids encoding the given CVP it is preferred to use 2, 3, 4, 5, 6, or more different layouts of the nucleic acids, wherein each layout comprises one or more, preferably 2, 3, 4, 5, 6, 7, 8, 9, or 10 or more nucleic acids encoding polypeptides comprising or consisting of the same FSPs and mFSPs or antigenic fragments thereof, i.e. encode the same CVP. It is particularly, preferred that a given collection of nucleic acids encoding the CVP of the fourth or fifth aspect of the invention is provided in two different layouts and comprises one or more, preferably 2, 3, 4, 5, 6, 7, 8, 9, or 10 or more nucleic acids encoding polypeptides, most preferably 4 nucleic acids encoding polypeptides comprising or consisting of the same FSPs and mFSPs or antigenic fragments thereof, three different layouts and comprises one or more, preferably 2, 3, 4, 5, 6, 7, 8, 9, or 10 or more nucleic acids encoding polypeptides, most preferably 4 nucleic acids encoding polypeptides comprising or consisting of the same FSPs and mFSPs or antigenic fragments thereof, four different layouts and comprises one or more, preferably 2, 3, 4, 5, 6, 7, 8, 9, or 10 or more nucleic acids encoding polypeptides, most preferably 4 nucleic acids encoding polypeptides comprising or consisting of the same FSPs and mFSPs or antigenic fragments thereof, five different layouts and comprises one or more, preferably 2, 3, 4, 5, 6, 7, 8, 9, or 10 or more nucleic acids encoding polypeptides, most preferably 4 nucleic acids encoding polypeptides comprising or consisting of the same FSPs and mFSPs or antigenic fragments thereof, or six different layouts and comprises one or more, preferably 2, 3, 4, 5, 6, 7, 8, 9, or 10 or more nucleic acids encoding polypeptides, most preferably 4 nucleic acids encoding polypeptides comprising or consisting of the same FSPs and mFSPs or antigenic fragments thereof.

Further examples of such nucleic acid collections encoding FSPs and mFSPs of SEQ ID NO: 1 to 209, encoding the same CVP, but with different layout are provided in SEQ ID NO: 1123 to 1126 for layout A and SEQ ID NO: 1187 to 1190 for layout C with hTPA; SEQ ID NO: 1127 to 1130 for layout B and SEQ ID NO: 1191 to 1194 for layout D with hTPA; SEQ ID NO: 1131 to 1134 for layout A and SEQ ID NO: 1195 to 1198 for layout C with hINV and SEQ ID NO: 1135 to 1138 for layout B and SEQ ID NO: 1199 to 1202 for layout D with hINV.

In a preferred embodiment, a Kozak sequence (CGCGACTTCGCCGCC (SEQ ID NO: 1220)) may be placed immediately upstream of the start codon of the collection nucleic acid according to the fourth or sixth aspect of the invention to allow for efficient initiation of translation and a TAA stop codon was placed downstream of the HA tag. Finally, it is preferred that the collection of nucleic acid comprises two flanking segments comprising unique restriction sites to facilitate the sub-cloning of the cassettes were added at the 5'- and 3'-end of the nucleotide sequence, respectively (FIG. 7).

The collection of nucleic acids of the fourth and sixth aspect of the present invention may also be comprised in an expression cassette.

In a seventh aspect the invention relates to a collection of one or more expression vectors each comprising all or part of the collection of nucleic acids of the fourth or sixth aspect of the invention, wherein the entirety of the collection of expression vectors comprise all of the collection of nucleic acids of the fourth or sixth aspect of the invention, i.e. wherein the collection of expression comprises nucleic acids encoding all FSPs, mFSP or antigenic fragments thereof of a given CVP.

It is preferred that the collection of expression vectors of comprise one or more elements that enhance immunogenicity of the expression vector. Preferably such elements are expressed as a fusion to the FSPs, mFSPs or antigenic fragments thereof or are encoded by another nucleic acid comprised in the vector, preferably in an expression cassette.

In a preferred embodiment the element that enhances immunogenicity of the CVP are selected from the group consisting of an invariant chain sequence or immune stimulatory fragment thereof; a tissue-type plasminogen activator; a PEST sequence; a cyclin destruction box; an ubiquitination signal; a SUMOylation signal; an Interleukin, preferably an Interleukin 2, Interleukin 12, or Interleukin 15; a checkpoint protein specific ligand, preferably an anti-PD1 antibody or PD1-binding fragment thereof, an anti-CTLA4 antibody or an anti-CTLA4-binding fragment thereof, an anti-LAGS antibody or an anti-LAGS-binding fragment, an anti-TIM3 antibody or an anti-TIM3-binding fragment thereof.

In a preferred embodiment of the collection of expression vectors of the seventh aspect each expression vector of the collection is independently selected from the group consisting of a plasmid; a cosmid; an RNA; an RNA-formulated with an adjuvant; an RNA formulated in liposomal particles; a self-amplifying RNA (SAM); a SAM formulated with an adjuvant; a SAM formulated in liposomal particles; a viral vector; preferably an alphavirus vector, a venezuelan equine encephalitis (VEE) virus vector, a sindbis (SIN) virus vector, a semliki forest virus (SFV) virus vector, also preferably a replication competent or incompetent adenoviral vector preferably derived from chimpanzee or bonobo or gorilla, a poxvirus vector, a vaccinia virus vector or a modified vaccinia ankara (MVA) vector, a simian or human cytomegalovirus (CMV) vector, a Lymphocyte choriomeningitis virus (LCMV) vector, a retroviral or lentiviral vector. It is preferred that all expression vectors used in one collection are of the same type, e.g. replication incompetent adenoviral vectors.

The most preferred expression vectors are adenoviral vectors, in particular adenoviral vectors derived from human or non-human great apes. Preferred great apes from which the adenoviruses are derived are Chimpanzee (Pan), Gorilla (Gorilla) and orangutans (Pongo), preferably Bonobo (Pan paniscus) and common Chimpanzee (Pan troglodytes). Typically, naturally occurring non-human great ape adenoviruses are isolated from stool samples of the respective great ape. The most preferred vectors are non-replicating adenoviral vectors based on hAd5, hAd11, hAd26, hAd35, hAd49, ChAd3, ChAd4, ChAd5, ChAd6, ChAd7, ChAd8, ChAd9, ChAd10, ChAd11, ChAd16, ChAd17, ChAd19, ChAd20, ChAd22, ChAd24, ChAd26, ChAd30, ChAd31, ChAd37, ChAd38, ChAd44, ChAd55, ChAd63, ChAd73, ChAd82, ChAd83, ChAd146, ChAd147, PanAd1, PanAd2, and PanAd3 vectors or replication-competent Ad4 and Ad7 vectors. The human adenoviruses hAd4, hAd5, hAd7, hAd11, hAd26, hAd35 and hAd49 are well known in the art. Vectors based on naturally occurring ChAd3, ChAd4, ChAd5, ChAd6, ChAd7, ChAd8, ChAd9, ChAd10, ChAd11, ChAd16, ChAd17, ChAd19, ChAd20, ChAd22, ChAd24, ChAd26, ChAd30, ChAd31, ChAd37, ChAd38, ChAd44, ChAd63 and ChAd82 are described in detail in WO 2005/071093. Vectors based on naturally occurring PanAd1, PanAd2, PanAd3, ChAd55, ChAd73, ChAd83, ChAd146, and ChAd147 are described in detail in WO 2010/086189.

In a particular embodiment, the adenovector is Gad20 (also termed GADNOU20, SEQ ID NO: 1219) or is derived therefrom. In one embodiment, derived therefrom means that the adenovector has at least 85%, and preferably at least 90%, 95%, 96%, 97%, 98% or 99% sequence identity to SEQ ID NO: 1219. In a preferred embodiment, however, it means the following:

The adenovector encodes an adenovirus hexon protein comprising:
(i) a first hypervariable region HVR1 comprising an amino acid (aa) sequence encoded by nucleotides 19386-19472 of SEQ ID NO: 1219, or a variant thereof having at least 85% aa sequence identity and with no A and preferably with a V at aa position 27,
(ii) a second hypervariable region HVR2 comprising an aa sequence encoded by nucleotides 19527-19571 of SEQ ID NO: 1219, or a variant thereof having at least 85% aa sequence identity and with no L and preferably with an I at aa position 1,
(iii) a third hypervariable region HVR3 comprising an aa sequence encoded by nucleotides 19623-19643 of SEQ ID NO: 1219, or a variant thereof having at least 85% aa sequence identity and with no V and preferably with an A at aa position 7,
(iv) a fourth hypervariable region HVR4 comprising an aa sequence encoded by nucleotides 19737-19772 of SEQ ID NO: 1219, or a variant thereof having at least 85% aa sequence identity,
(v) a fifth hypervariable region HVR5 comprising an aa sequence encoded by nucleotides 19794-19838 of SEQ ID NO: 1219, or a variant thereof having at least 85% aa sequence identity,
(vi) a sixth hypervariable region HVR6 comprising an aa sequence encoded by nucleotides 19908-19934 of SEQ ID NO: 1219, or a variant thereof having at least 85% aa sequence identity, and
(vii) a seventh hypervariable region HVR7 comprising an aa sequence encoded by nucleotides 20259-20336 of SEQ ID NO: 1219, or a variant thereof having at least 85% aa sequence identity with no I and preferably with a V at aa position 1.

In a preferred embodiment, the HVR variants have at least 90%, and more preferably at least 95% sequence identity. Alternative to the definition by a percentage level of sequence identity, the HVR variants can be defined to have a certain number of amino acid mutations compared to the encoded sequence. The number of mutations is then as follows: instead of at least 85% sequence identity, up to 4 mutations in HVR1, up to 2 mutations in HVR2, up to 1 mutation in HVR3, up to 1 mutation in HVR4, up to 2 mutations in HVR5, up to 1 mutations in HVR6, and up to 3 mutations in HVR7; instead of at least 90% sequence identity, up to 2 mutations in HVR1, up to 1 mutation in HVR2, up to 1 mutation and preferably no mutation in HVR3, up to 1 mutation in HVR4, up to 1 mutation in HVR5, up to 1 mutation and preferably no mutation in HVR6, and up to 2 mutations in HVR7; instead of at least 95% sequence identity, up to 1 mutation in HVR1, up to 1 mutation and preferably no mutation in HVR2, up to 1 mutation and preferably no mutation in HVR3, up to 1 mutation and preferably no mutation in HVR4, up to 1 mutation and preferably no mutation in HVR5, up to 1 mutation and preferably no mutation in HVR6, and up to 1 mutation in HVR7.

As known in the art, e.g. from Bradley et al. (J Virol., 2012 January; 86(2):1267-72), adenovirus neutralizing antibodies target the hexon hypervariable regions, and by replacing the HVR regions of an adenovirus with serumprevalence, that adenovirus can evade the immune system in the immune host. Thus, while the above HVRs can be used with the respective hexon proteins defined below, they have utility independent from those hexon proteins and also from the below penton and fiber proteins, namely by replacing the hexon HVRs in a different adenovirus having other hexon, penton and/or fiber proteins.

In a preferred embodiment, the hexon protein comprises an amino acid sequence encoded by nucleotides 18981-21845 of SEQ ID NO: 1219, or a variant thereof having at least 85% sequence identity, In a preferred embodiment, the hexon variants have at least 90%, and preferably at least 95%, 96%, 97%, 98% or 99% sequence identity. Alternative to the definition by a percentage level of sequence identity, the hexon variants can be defined to have a certain number of amino acid mutations compared to the encoded sequence. The number of mutations is then as follows: instead of at least 85% sequence identity, up to 143 mutations; instead of at least 90% sequence identity, up to 95 mutations; instead of at least 95% sequence identity, up to 47 mutations; instead of at least 96% sequence identity, up to 38 mutations; instead of at least 97% sequence identity, up to 28 mutations; instead of at least 98% sequence identity, up to 19 mutations; instead of at least 99% sequence identity, up to 9 mutations. It is to be understood that the hexon variants do not have less sequence identity to or more mutations in their HVRs than defined for the respective HVRs above.

In one embodiment, the adenovector further encodes an adenoviral penton protein comprising an amino acid sequence encoded by nucleotides 14021-15973 of SEQ ID NO: 1219, or a variant thereof having at least 85% sequence identity. In a preferred embodiment, the penton variants have at least 90%, and preferably at least 95%, 96%, 97%, 98% or 99% sequence identity compared to the encoded sequence. Alternative to the definition by a percentage level of sequence identity, the penton variants can be defined to have a certain number of amino acid mutations. The number of mutations is then as follows: instead of at least 85% sequence identity, up to 97 mutations; instead of at least 90% sequence identity, up to 65 mutations; instead of at least 95% sequence identity, up to 32 mutations; instead of at least 96% sequence identity, up to 26 mutations; instead of at least 97% sequence identity, up to 19 mutations; instead of at least 98% sequence identity, up to 13 mutations; instead of at least 99% sequence identity, up to 6 mutations.

Preferably, the penton variants have no D and preferably a G at amino acid position 289 and no D and preferably an N at amino acid position 341.

In another embodiment, the adenovector further (i.e. next to the hexon and possibly the penton protein) encodes an adenoviral fiber protein comprising an amino acid sequence encoded by nucleotides 32163-33956 of SEQ ID NO: 1219, or a variant thereof having at least 85% sequence identity. In a preferred embodiment, the fiber variants have at least 90%, and preferably at least 95%, 96%, 97%, 98% or 99% sequence identity. Alternative to the definition by a percentage level of sequence identity, the fiber variants can be defined to have a certain number of amino acid mutations compared to the encoded sequence. The number of mutations is then as follows: instead of at least 85% sequence identity, up to 89 mutations; instead of at least 90% sequence identity, up to 59 mutations; instead of at least 95% sequence identity, up to 29 mutations; instead of at least 96% sequence identity, up to 23 mutations; instead of at least 97% sequence identity, up to 17 mutations; instead of at least 98% sequence identity, up to 11 mutations; instead of at least 99% sequence identity, up to 5 mutations.

Preferably, the fiber variants have no A and preferably a P at amino acid position 181, no V and preferably an I at amino acid position 474, and/or no insertion of an S and preferably no amino acid insertion between amino acid positions 4 and 5.

In another embodiment, the adenovector further (i.e. next to the hexon and possibly the penton and/or fiber protein) encodes a VA RNA II non-coding RNA comprising a nucleotide sequence according to nucleotides 10724-10897 of SEQ ID NO: 1219, or a variant of the nucleotide sequence having at least 85% sequence identity. Alternatively or in addition, it may encode a VA RNA I non-coding RNA comprising a nucleotide sequence according to nucleotides 10492-10659 of SEQ ID NO: 1219, or a variant of the nucleotide sequence having at least 85% sequence identity. In a preferred embodiment, the VA RNA variants have at least 90%, and preferably at least 95%, 96%, 97%, 98% or 99% sequence identity. Alternative to the definition by a percentage level of sequence identity, the VA RNA variants can be defined to have a certain number of nucleotide mutations. The number of mutations is then as follows: instead of at least 85% sequence identity, up to 25 mutations in VA RNA I and up to 26 mutations in VA RNA II; instead of at least 90% sequence identity, up to 16 mutations in VA RNA I and up to 17 mutations in VA RNA II; instead of at least 95% sequence identity, up to 8 mutations in any VA RNA; instead of at least 96% sequence identity, up to 6 mutations in any VA RNA; instead of at least 97% sequence identity, up to 5 mutations in any VA RNA; instead of at least 98% sequence identity, up to 3 mutations in any VA RNA; instead of at least 99% sequence identity, up to 1 mutation in any VA RNA.

Preferably, the VA RNA II variant (a) no C at position 79 and/or no A at position 80, and preferably a T at position 79 and/or a G at position 80, and (b) no A at position 81, and preferably a G at position 81. The VA RNA I variant preferably has no G at position 80 and preferably has an A at position 80.

A VA RNA according to the invention leads to an improved adenovirus production.

It is preferred that the adenovector further comprises other adenoviral genes and nucleotide segments, which are adjacent to the hexon, penton and/or fiber gene in the adenovirus genome, using SEQ ID NO: 1219 as a reference. It is particularly preferred that the adenovector also comprises sequences required for packaging of the polynucleotide into an adenoviral particle.

Generally, it is preferred that the adenovector comprises at least one of the following:
(a) an adenoviral 5'-end, preferably an adenoviral 5' inverted terminal repeat;
(b) an adenoviral E1a region, or a fragment thereof selected from among the 13S, 12S and 9S regions;
(c) an adenoviral E1b region, or a fragment thereof selected from among the group consisting of the small T, large T and IX regions;
(d) an adenoviral VA RNA region; or a fragment thereof selected from among the group consisting of the VA RNA I and VA RNA II regions;
(e) an adenoviral E2b region; or a fragment thereof selected from among the group consisting of the small pTP, Polymerase and IVa2 regions;
(f) an adenoviral L1 region, or a fragment thereof, said fragment encoding an adenoviral protein selected from the group consisting of the 28.1 kD protein, polymerase, agnoprotein, 52/55 kDa protein, and Ma protein;
(g) an adenoviral L2 region, or a fragment thereof, said fragment encoding an adenoviral protein selected from the group consisting of the penton protein as defined above, VII, V, and X protein;
(h) an adenoviral L3 region, or a fragment thereof, said fragment encoding an adenoviral protein selected from the group consisting of the VI protein, hexon protein as defined above, and endoprotease;
(i) an adenoviral E2a region, or a fragment thereof, said fragment encoding an adenoviral protein consisting of the DBP protein;
(j) an adenoviral L4 region, or a fragment thereof said fragment encoding an adenoviral protein selected from the group consisting of the 100 kD protein, the 22 kD homolog, the 33 kD homolog, and protein VIII;
(k) an adenoviral E3 region, or a fragment thereof selected from the group consisting of E3 ORF1, E3 ORF2, E3 ORF3, E3 ORF4, E3 ORF5, E3 ORF6, E3 ORF7, E3 ORF8 and E3 ORF5;
(l) an adenoviral L5 region, or a fragment thereof said fragment encoding the fiber protein as defined above;
(m) an adenoviral E4 region, or a fragment thereof selected from the group consisting of E4 ORF6/7, E4 ORF6, E4 ORF5, E4 ORF4, E4 ORF3, E4 ORF2, and E4 ORF1;
(n) an adenoviral 3'-end, preferably an adenoviral 3' inverted terminal repeat; and/or
(o) an adenoviral E1 region.

These elements can be from the same adenovirus according to SEQ ID NO: 1219, or from a different adenovirus, in particular from one of a different species, e.g. a human adenovirus, to form a chimeric adenovirus.

In some embodiments of the adenovector it may be desirable that it does not comprise one or more genomic regions as outlined above (as in (a) to (m)). In particular it may not comprise an E1, E3 and/or E4 region, and/or comprises an adenoviral gene which comprises a deletion and/or mutation which renders the at least one gene non-functional. In these preferred embodiments, the suitable adenoviral regions is modified to not include the aforementioned region(s)/gene(s) or to render the selected region(s)/gene(s) non-functional. One possibility to render them non-functional is to introduce one or more artificial stop-codons (e.g. TAA) into the open reading frame of these genes. Methods of rendering the virus replication-defective are well known in the art (see e.g. Brody et al, 1994 Ann NY Acad Sci., 716: 90-101). A deletion can make space to insert transgenes, preferably within an expression cassette, such as a minigene cassette. Furthermore, deletions can be used to generate adenoviral vectors which are incapable to replicate without the use of a packaging cell line or a helper virus as is well known in the art. Such a recombinant adenovirus comprising one or more of the specified gene/region deletions or loss-of-function mutations can provide a safer recombinant adenovirus for e.g. gene therapy or vaccination.

While the adenovector may not comprise at least one genomic region/gene as outlined herein (such as e.g. region E1, E3 and/or E4), specifically E1A, E1B, E2A, E2B, E3 ORF1, E3 ORF2, E3 ORF3, E3 ORF4, E3 ORF5, E3 ORF6, E3 ORF7, E3 ORF8, E3 ORF9, E4 ORF6/7, E4 ORF6, E4 ORF5, E4 ORF4, E4 ORF3, E4 ORF2 and/or E4 ORF1, preferably E1A, E1B, E2A, E2B, E3 and/or E4, and/or comprises an adenoviral gene which comprises a deletion and/or mutation which renders the at least one gene non-functional, it is desirable to retain an intact E1a and/or E1b region. Such an intact E1 region may be located in its native location in the adenoviral genome or placed in the site of a deletion in the native adenoviral genome (e.g., in the E3 region).

In a preferred embodiment, the adenovector further encodes one or more, preferably all of the following adenoviral proteins: protein VI, protein VIII, protein IX, protein Ma and protein IVa2.

An average person skilled in the art of adenoviruses is well aware of how to determine the open reading frames that encode for the above-specified adenoviral proteins. He is also aware of the structure of adenoviral genomes and can map, without undue burden, the individual adenoviral regions and ORFs outlined herein to any adenoviral genome.

The term "hexon protein" refers to the hexon (II) protein comprised in an adenovirus. A hexon protein or a variant thereof according to the invention has the same function as a hexon protein or a fragment thereof in an infectious adenovirus virion. Thus, an adenovirus comprising said hexon or variant thereof preferably as a capsid protein is capable of entering a host cell. A suitable method for generating variants of a hexon protein is described in U.S. Pat. No. 5,922,315. In this method, at least one loop region of the adenovirus hexon is changed with at least one loop region of another adenovirus serotype. It can be easily determined if a recombinant adenovirus can enter a host cell. For example, after contacting a host cell with the adenovirus, the recombinant host cell can be washed and lysed and it can be determined whether adenoviral RNA and/or DNA is found in the host cell using, e.g. an appropriate hybridization probe specific for adenoviral RNA and/or DNA. Alternatively or additionally, the host cell after having been brought into contact with the recombinant adenovirus may be washed, lysed and probed with adenovirus specific antibodies, e.g. using a Western blot. In yet another alternative, it is observed, e.g. in vivo, whether the host cell expresses a gene product, for example a fluorescent protein upon infection with a recombinant adenovirus that comprises a suitable expression cassette to express the gene product in the host cell.

The term "hypervariable region" (HVR) refers to domains with high sequence variation between strains, located at the solvent-exposed surface of the hexon protein, so exposed on the outside of the viral capsid. They are major determinants of neutralizing antibodies. HVRs can be identified, for example, by sequence alignment with other hexon proteins.

By "adenoviral penton protein" is meant the penton base (III) protein comprised in an adenovirus. An adenoviral penton protein is characterized in that it localizes to the corners of the icosahedral symmetry of the capsid. A penton protein or a variant thereof according to the invention has the same function as a penton protein in an infectious adenovirus virion. Thus, an adenovirus comprising said penton or variant thereof preferably as a capsid protein is capable of entering a host cell, which can be tested as described above. Further, a functional penton has an affinity to an adenoviral fiber protein. The average skilled person is well aware of how to test protein-protein affinities. To determine if a first protein is capable of binding a second protein, he may use, for example, a genetic yeast two-hybrid assay or a biochemical assay such as a pull-down, an enzyme-linked immunosorbent assay (ELISA), a fluorescence-activated cell sorting (FACS)-based assay or a Plasmon resonance assay. When using pull-down or Plasmon resonance assays, it is useful to fuse at least one of the proteins to an affinity tag such as HIS-tag, GST-tag or other, as is well known in the art of biochemistry.

The term "fiber protein" refers to the knobbed fiber (IV) protein comprised in an adenovirus. A fiber protein or a variant thereof according to the invention has the same function as a fiber protein or a fragment thereof in an infectious adenovirus virion. Thus, an adenovirus comprising said fiber or fiber variant preferably as a capsid protein is capable of entering a host cell, which can be tested as described above. Further, a functional fibre protein has an affinity to an adenoviral penton protein. Also, a functional adenoviral fiber protein in its glycosylated form is capable of trimerizing. Thus, it is also preferred that the variant is capable of being glycosylated and/or of forming a trimer. Affinity, including trimerization, can be tested as described above, and glycosylation assays are also well-known in the art.

The "VA (viral associated) RNA" is a type of non-coding found in adenovirus. It plays a role in regulating translation. There are two copies of this RNA called VAI or VA RNA I and VAII or VA RNA II. The two VA RNA genes are distinct genes in the adenovirus genome. VA RNA I is the major species with VA RN AII expressed at a lower level. Neither transcript is polyadenylated and both are transcribed by PolIII.

The term "identity" or "identical" in the context of polynucleotide, polypeptide or protein sequences refers to the number of residues in the two sequences that are identical when aligned for maximum correspondence. Specifically, the percent sequence identity of two sequences, whether nucleic acid or amino acid sequences, is the number of exact matches between two aligned sequences divided by the length of the shorter sequence and multiplied by 100. Alignment tools that can be used to align two sequences are well known to the person skilled in the art and can, for example, be obtained on the World Wide Web, e.g., Clustal Omega (www.ebi.ac.uk/Tools/msa/clustalo/) for polypeptide alignments or MUSCLE (www.ebi.ac.uk/Tools/msa/muscle/) or MAFFT (www.ebi.ac.uk/Tools/msa/mafft/) for polynucleotide alignments or WATER (www.ebi.ac.uk/Tools/psa/emboss_water/) for polynucleotide and polypeptide alignments. The alignments between two sequences may be carried out using default parameters settings, e.g. for MAFFT preferably: Matrix: Blosum62, Gap Open 1.53, Gap Extend 0.123, for WATER polynucleotides preferably: MATRIX: DNAFULL, Gap Open: 10.0, Gap Extend 0.5 and for WATER polypeptides preferably MATRIX: BLOSUM62, Gap Open: 10.0, Gap Extend: 0.5. Those skilled in the art understand that it may be necessary to introduce gaps in either sequence to produce a satisfactory alignment. The "best sequence alignment" is defined as the alignment that produces the largest number of aligned identical residues while having a minimal number of gaps. Preferably, it is a global alignment, which includes every residue in every sequence in the alignment.

The term "variant" refers, with respect to a polypeptide, generally to a modified version of the polypeptide, e.g. a mutation, so one or more amino acids of the polypeptide may be deleted, inserted, modified and/or substituted. Generally, the variant is functional, meaning that an adenovirus comprising the functional variant is capable of infecting a host cell. More specific functions are defined herein and have precedence over the general definition. A "mutation" or "amino acid mutation" can be an amino acid substitution, deletion and/or insertion ("and" may apply if there is more than one mutation). Preferably, it is a substitution (i.e. a conservative or non-conservative amino acid substitution), more preferably a conservative amino acid substitution. In some embodiments, a substitution also includes the exchange of a naturally occurring amino acid with a not naturally occurring amino acid. A conservative substitution comprises the substitution of an amino acid with another amino acid having a chemical property similar to the amino acid that is substituted. Preferably, the conservative substitution is a substitution selected from the group consisting of:
(i) a substitution of a basic amino acid with another, different basic amino acid;
(ii) a substitution of an acidic amino acid with another, different acidic amino acid;
(iii) a substitution of an aromatic amino acid with another, different aromatic amino acid;
(iv) a substitution of a non-polar, aliphatic amino acid with another, different non-polar, aliphatic amino acid; and
(v) a substitution of a polar, uncharged amino acid with another, different polar, uncharged amino acid.

A basic amino acid is preferably selected from the group consisting of arginine, histidine, and lysine. An acidic amino acid is preferably aspartate or glutamate. An aromatic amino acid is preferably selected from the group consisting of phenylalanine, tyrosine and tryptophane. A non-polar, aliphatic amino acid is preferably selected from the group consisting of glycine, alanine, valine, leucine, methionine and isoleucine. A polar, uncharged amino acid is preferably selected from the group consisting of serine, threonine, cysteine, proline, asparagine and glutamine. In contrast to a conservative amino acid substitution, a non-conservative amino acid substitution is the exchange of one amino acid with any amino acid that does not fall under the above-outlined conservative substitutions (i) through (v).

Means for determining sequence identity are described above.

Amino acids of a protein may also be modified, e.g. chemically modified. For example, the side chain or a free amino or carboxy-terminus of an amino acid of the protein or polypeptide may be modified by e.g. glycosylation, amidation, phosphorylation, ubiquitination, etc. The chemical modification can also take place in vivo, e.g. in a host-cell, as is well known in the art. For example, a suitable chemical modification motif, e.g. glycosylation sequence motif present in the amino acid sequence of the protein will cause the protein to be glycosylated. Unless a modification leads to a change in identity of a modified amino acid (e.g. a substitution or deletion), a modified polypeptide is within the scope of polypeptide as mentioned, i.e. it is not a variant as defined herein.

The term "variant" refers, with respect to a polynucleotide, generally to a modified version of the polynucleotide, e.g. a mutation, so one or more nucleotides of the polynucleotide may be deleted, inserted, modified and/or substituted. Generally, the variant is functional, meaning that an adenovirus comprising the functional variant is capable of infecting a host cell. More specific functions are defined herein and have precedence over the general definition. A "mutation" can be a nucleotide substitution, deletion and/or insertion ("and" may apply if there is more than one mutation). Preferably, it is a substitution, more preferably it causes an amino acid substitution, most preferably a conservative amino acid substitution.

Generally, it is preferred that all expression vectors of the collection of expression vectors, i.e. the collection of expression vectors comprising nucleic acids encoding all FSPs, mFSP and antigenic fragments thereof of the respective CVP are of one type, e.g. a replication competent adenovirus. In the embodiment of the invention in which different layouts of the same CVP or nucleic acids encoding this are used, each layout will be comprised in a separate collection of expression vectors. Thus, each layout may be comprised in the same expression vector or in different expression vectors. The latter is preferred in those instances in which the expression vector itself is antigenic in the patient. Thus, the change of the type of expression vector between two or more repeat administrations of the same CVP, preferably in different layouts increase the chance that the CVP is expressed in the patient.

The present invention also relates to a CVP of the fourth or fifth aspect of the present invention, a collection of nucleic acids of the fourth or sixth aspect of the present invention, or an expression vector collection of the seventh aspect of the present invention, for use in medicine.

The present invention also relates to pharmaceutical composition comprising a CVP of the fourth or fifth aspect of the present invention, a collection of nucleic acids of the fourth or sixth aspect of the present invention, or an expression vector collection of the seventh aspect of the present invention.

In case that different layouts of the same CVP, of nucleic acids encoding such different layouts of the same CVP or expression vectors comprising such nucleic acids with different layouts are used in a homologous or heterologous prime-boost administration regimen (see below) the term "pharmaceutical composition" also covers two physically separated compositions that allow separate administration of the same CVP, of nucleic acids encoding such different layouts of the same CVP or expression vectors comprising such nucleic acids with different layouts.

In preferred embodiments the pharmaceutical composition further comprises a pharmaceutically acceptable carrier and/or excipient and optionally one or more additional active substances. Preferably, the composition of the fifth aspect contains a therapeutically effective amount of the compound, preferably in purified form, together with a suitable amount of carrier and/or excipient so as to provide the form for proper administration to the patient. The formulation should suit the mode of administration.

The pharmaceutical compositions can take the form of solutions, suspensions, emulsion, tablets, pills, capsules, powders, sustained-release formulations and the like. The pharmaceutical composition can be formulated as a suppository, with traditional binders and carriers such as triglycerides.

For preparing pharmaceutical compositions of the present invention, pharmaceutically acceptable carriers can be either solid or liquid. Solid form compositions include powders, tablets, pills, capsules, lozenges, cachets, suppositories, and dispersible granules. A solid excipient can be one or more substances, which may also act as diluents, flavouring agents, binders, preservatives, tablet disintegrating agents, or an encapsulating material. In powders, the excipient is preferably a finely divided solid, which is in a mixture with the finely divided inhibitor of the present invention. In tablets, the active ingredient is mixed with the carrier having the necessary binding properties in suitable proportions and compacted in the shape and size desired. Suitable excipients are magnesium carbonate, magnesium stearate, talc, sugar, lactose, pectin, dextrin, starch, gelatin, tragacanth, methylcellulose, sodium carboxymethylcellulose, a low melting wax, cocoa butter, and the like. For preparing suppositories, a low melting wax, such as a mixture of fatty acid glycerides or cocoa butter, is first melted and the active component is dispersed homogeneously therein, as by stirring. The molten homogeneous mixture is then poured into convenient sized moulds, allowed to cool, and thereby to solidify. Tablets, powders, capsules, pills, cachets, and lozenges can be used as solid dosage forms suitable for oral administration.

Liquid form compositions include solutions, suspensions, and emulsions, for example, water, saline solutions, aqueous dextrose, glycerol solutions or water/propylene glycol solutions. For parenteral injections (e.g. intravenous, intraarterial, intraosseous infusion, intramuscular, subcutaneous, intraperitoneal, intradermal, and intrathecal injections), liquid preparations can be formulated in solution in, e.g. aqueous polyethylene glycol solution. A saline solution is a preferred carrier when the pharmaceutical composition is administered intravenously.

Preferably, the pharmaceutical composition is in unit dosage form. In such form the composition may be subdivided into unit doses containing appropriate quantities of the active component. The unit dosage form can be a packaged composition, the package containing discrete quantities of the composition, such as packaged tablets, capsules, and powders in vials or ampoules. Also, the unit dosage form can be a capsule, an injection vial, a tablet, a cachet, or a lozenge itself, or it can be the appropriate number of any of these in packaged form.

The composition, if desired, can also contain minor amounts of wetting or emulsifying agents, or pH buffering agents.

Furthermore, such pharmaceutical composition may also comprise other pharmacologically active substance such as but not limited to adjuvants and/or additional active ingredients. Adjuvants in the context of the present invention include but are not limited to inorganic adjuvants, organic adjuvants, oil-based adjuvants, cytokines, particulate adjuvants, virosomes, bacterial adjuvants, synthetic adjuvants, or synthetic polynucleotides adjuvants.

In an eighth aspect, the present invention relates to a CVP of the fourth or fifth aspect of the present invention, a collection of nucleic acids of the fourth of sixth aspect of the present invention, or an expression vector collection of the seventh aspect of the present invention, for use in prophylaxis or treatment of a patient with a cancer comprising cancer cells with an MSI phenotype or being at risk of developing such cancer, wherein the cancer is preferably selected from the group consisting of colorectal cancer, gastric cancer, endometrial cancer, small intestine cancer, hepatobiliary tract cancer, liver cancer, neuroendocrine cancers, cervical cancer, ovarian cancer, uterine sarcomas, brain cancer and skin cancer As outlined above one particular advantage of the universal vaccine of the present invention is the fact that it provides prophylaxis or therapy of more than just one cancer type. Accordingly, it is preferred according to the eighth aspect to provide prophylaxis or therapy for at least two types of MSI cancers, more preferably at least three types of MSI cancers. Preferably, colorectal cancer, gastric cancer, endometrial cancer, small intestine cancer, hepatobiliary tract cancer, liver cancer, neuroendocrine cancers, cervical cancer, ovarian cancer, uterine sarcomas, brain cancer and skin cancer.

Prophylaxis is in the context of the present invention preferably for patients known to be at risk of developing MSI cancers according to clinical guidelines, including patients with germline mutations in genes involved in the mismatch repair system (MMR) such as MLH-1, MSH-2, MSH-6, PMS2 and TACSTD1/EPCAM. Treatment is for patients with cancers at all stages (I-IV), arising in any tissue after diagnosis of MSI status according to most recent clinical guidelines. The use of such vaccine is intended for treatment of cancers with an MSI status that can be either spontaneous or pharmacologically induced.

In many cases, a single administration of the CVP is not sufficient to generate the number of long-lasting immune cells which is required for effective protection against tumor diseases or for therapeutically treating a tumor disease. Consequently, repeated challenge with a biological preparation specific for a specific disease is required in order to establish lasting and protective immunity against said disease or to cure a given disease. An administration regimen comprising the repeated administration of a CVP, the collection of nucleic acids encoding such CVP or a collection of expression vectors comprising such nucleic acid is referred to in the present as "prime-boost vaccination regimen". Preferably, a prime-boost vaccination regimen involves at least two administrations of a CVP, the collection of nucleic acids encoding such CVP or a collection of expression vectors comprising such nucleic acid. The first administration of the CVP, the collection of nucleic acids encoding such CVP or a collection of expression vectors comprising such nucleic acid is referred to as "priming" and any subsequent administration of the same CVP, the collection of nucleic acids encoding such CVP or a collection of expression vectors comprising such nucleic acid is referred to as "boosting". It is understood from above explanation that the same CVP may nevertheless be administered in different layouts in each subsequent administrations of the CVP, the collection of nucleic acids encoding such CVP or a collection of expression vectors comprising such nucleic acid.

Thus, in a preferred embodiment of the present invention the prime-boosting vaccination regimen involves one administration of the CVP, the collection of nucleic acids encoding such CVP or a collection of expression vectors comprising such nucleic acid for priming the immune response and at least one subsequent administration for boosting the immune response. It is to be understood that 2, 3, 4 or even 5 administrations for boosting the immune response are also contemplated by the present invention.

The period of time between prime and boost is, preferably, 1 week, 2 weeks, 4 weeks, 6 weeks or 8 weeks. More preferably, it is 4 weeks or 8 weeks. If more than one boost is performed, the subsequent boost is, preferably, administered 1 week, 2 weeks, 4 weeks, 6 weeks or 8 weeks after the preceding boost. More preferably, the interval between any two boosts is 4 weeks or 8 weeks.

The prime-boost vaccination regimens of the present invention may be homologous or heterologous. In homologous prime-boost regimens both the priming and the at least one boosting is performed using the same means of administration of the CVP, the collection of nucleic acids encoding such CVP or a collection of expression vectors comprising such nucleic acid. In heterologous prime-boosting regimens a different means for priming and for boosting the immune response are used. In the context of the present invention, a heterologous prime-boosting regimen could, e.g. comprise a poxviral vector for the priming of an immune response and a different expression vector or the CPV for the boosting of the immune response.

In one preferred embodiment of the present invention the prime-boosting vaccination regimen is homologous and in another preferred embodiment of the present invention the prime-boosting vaccination regimen is heterologous.

Accordingly, in one aspect the present invention relates to a collection of nucleic acids of the fourth or sixth aspect of the present invention and/or an expression vector collection of the seventh aspect of the present invention for use in prophylaxis or treatment of a patient with a cancer comprising cancer cells with an MSI phenotype or being at risk of developing such cancer, wherein the collection of nucleic acids and/or the expression vector collection is administered in a heterologous prime-boost vaccination scheme, preferably the prime is with an adenovirus vector and the one or more boosts with a poxviral vector, preferably an MVA vector.

EXAMPLES

Example 1: Selection of Mononucleotide Repeat (MNR) Mutations in Protein-Coding Genes of MSI Tumor Samples Mutation Annotation Format (MAF) files based on whole exome sequence data (release date 4.0-Oct. 31, 2016) and available from the TCGA data portal (gdc-portal.nci.nih.gov/) were analyzed for the presence of frameshift mutations (FSM) in MNRs equal or longer than 6 nucleotides located within protein-coding segments of exomes of protein-coding genes. Only tumors with a MSI phenotype as defined in the TCGA sample annotation data were considered in the analysis. This group comprised a total 320 tumor and matched normal control samples, corresponding to 69 MSI-high (MSI-H) colorectal (CRC), 85 MSI gastric and 166 MSI endometrial (EC) cancers. In a second filtering step, only FSMs derived from a 1 nucleotide deletion were accepted, as this type of FSM is the most frequently observed in CRC and EC tumors (1). The resulting list was further refined by accepting only those FSMs fulfilling the following criteria: (i) the number of reads harboring the mutation was significantly higher in the tumor compared to the matched normal sample (FDR-corrected Fisher-testp-va/ ue≤0.05); (ii) the allele frequency of the FSM in the matched normal sample was ≤25%. The remaining FSMs were filtered further by retaining only those FSMs that were present in at least 5% of tumor samples in one of the three analyzed tumor types (CRC, gastric, EC). In a final selection step, FSMs that fell in the following categories were excluded because deemed inappropriate for a vaccine: (i) presence of the FSM in ≥2% of samples from a collection of normal samples (EXAC database exac.broadinstitute.org/) and/or (ii) the mRNA expression (RSEM $\log_2$ expression value) of the FSM-carrying gene was within the lower 20 percentile value of all expressed protein-coding genes (TCGA gene-level mRNA expression data) considering all three tumor types (CRC, EC and gastric). The list thus obtained comprised 1283 FSMs and represents the CFSM for these tumors.

Example 2: Selection of a List of Frameshift Peptides with Acceptable Properties Each of the FSMs of the CFSM selected in Example 1 was then mapped onto the corresponding mRNA sequence (or sequences) from the NCBI REFSEQ database using ANNOVAR (Wang K, et al. (2010) NAR, 38:e164) and both the wild-type (wt) and the resulting mutated mRNA were translated into proteins. Comparison of the wt and mutated protein sequences allowed determining the amino acid (aa) sequence of the corresponding frame shift peptide (FSP). When an FSM generated multiple FSPs with different length and/or aa sequence due to the presence of multiple mRNA isoforms, all resulting FSPs were retained. The resulting list was filtered to exclude all FSPs shorter than 4 aa in that unable to yield potential CD8 T neo-epitopes.

Furthermore, the amino acid sequence of FSPs to be included in the CVP was modified by the addition or deletion of amino acids (or a FSP that did not fulfill certain criterions was excluded from after modification), if they fulfilled certain criterions: (i) if the FSP is shorter than 10 aa, 4 wt aa naturally occurring immediately N-terminally of the amino acid encoded by the FC is added to the N-terminus of the FSP to ensure the peptide (which is referred to as mFSP since it differs from the FSP as defined in the context of the present invention to be the complete translation product of the protein-encoding segment of a nucleic acid comprising a FSM starting from the codon encoding the first amino acid that is different relative to the translation product of the corresponding wild type (wt) nucleic acid without the FSM) that reached the minimum length of a putative CD8 T cell neo-epitope (8-10mer). Amino acid stretches shared between multiple FSPs deriving from the same FSM were only retained in the longest FSP, i.e. in the shorter FSPs these amino acid stretches were deleted. In a final step, any segment of 8 or more continuous amino acids also present in the wt human proteome (NCBI REFSEQ database) was removed from the FSPs to minimize the risk of inducing autoimmunity. If, after exclusion of the wt segment, the resulting FSP was shorter than 4 aa, it was removed from the list. The final group of FSPs thus obtained comprises of 1087 amino acid sequences (SEQ ID NO: 1 to 1087) encoded by 1059 FSMs (Table 1) and is referred to as CVP.

TABLE 1

For each of the 1087 FSPs, the SEQ ID NO is reported together with the genomic coordinates (hg19 assembly) of the FSM generating the FSP.

| SEQ ID NO | Genomic Coordinate FSM |
|---|---|
| 1 | chr18:34205516 |
| 2 | chr18:34205516 |
| 3 | chr1:6257785 |
| 4 | chr2:148683686 |
| 5 | chr17:56435161 |
| 6 | chr3:51417604 |
| 7 | chr5:79970915 |
| 8 | chr18:57013194 |
| 9 | chr5:145647320 |
| 10 | chr11:77784147 |
| 11 | chr13:115057211 |
| 12 | chr11:126137087 |
| 13 | chr2:165551296 |
| 14 | chr6:80751897 |
| 15 | chr7:151874148 |
| 16 | chr12:122242658 |
| 17 | chr6:108214755 |
| 18 | chr19:49850473 |
| 19 | chr7:77423460 |
| 20 | chr8:103289349 |
| 21 | chr3:100039736 |
| 22 | chr1:27621108 |
| 23 | chr3:136573486 |
| 24 | chr1:14108749 |
| 25 | chr14:24040436 |
| 26 | chr16:10867203 |
| 27 | chr12:64812755 |
| 28 | chr17:48433967 |
| 29 | chr1:231131567 |
| 30 | chr6:71508370 |
| 31 | chr19:49458971 |
| 32 | chr10:78729786 |
| 33 | chr11:62649529 |
| 34 | chr1:160589601 |
| 35 | chr3:114058003 |
| 36 | chr3:20216050 |
| 37 | chr10:70182521 |
| 38 | chr9:96422612 |
| 39 | chr5:140049102 |
| 40 | chr3:183665257 |
| 41 | chr5:145886723 |
| 42 | chr15:79750586 |
| 43 | chr1:45407182 |
| 44 | chr4:3430399 |
| 45 | chr1:28785730 |
| 46 | chr11:118220583 |
| 47 | chr2:203922058 |
| 48 | chrX:37312611 |
| 49 | chr10:111893350 |
| 50 | chr10:93601946 |
| 51 | chr1:155308000 |
| 52 | chr6:131481276 |
| 53 | chr1:23240246 |
| 54 | chr6:139097330 |
| 55 | chr2:207174428 |
| 56 | chr15:56736723 |
| 57 | chr21:38524243 |
| 58 | chr2:203420130 |
| 59 | chr10:890939 |
| 60 | chr5:131931452 |
| 61 | chr14:45693722 |
| 62 | chr20:49508204 |
| 63 | chr1:65306997 |
| 64 | chr2:165365288 |
| 65 | chr11:77920856 |
| 66 | chr17:57247171 |
| 67 | chr6:158508009 |
| 68 | chr3:142274740 |
| 69 | chr1:91967357 |
| 70 | chr16:19725706 |
| 71 | chr1:74575213 |
| 72 | chr2:178988920 |
| 73 | chr8:124384893 |
| 74 | chr1:27105931 |
| 75 | chr12:57422573 |
| 76 | chr3:157081227 |
| 77 | chr17:49077041 |
| 78 | chr17:49077041 |
| 79 | chr17:42756253 |
| 80 | chr21:16338330 |
| 81 | chr17:20108263 |
| 82 | chr9:35059647 |
| 83 | chr1:93667516 |
| 84 | chr15:64967247 |
| 85 | chr1:204228411 |
| 86 | chr17:7798765 |
| 87 | chr6:163899920 |
| 88 | chr13:50235209 |
| 89 | chrX:129190011 |
| 90 | chr5:64023941 |
| 91 | chr2:74687410 |
| 92 | chr7:100802405 |
| 93 | chr7:8198251 |
| 94 | chr15:42742957 |
| 95 | chr10:98336475 |
| 96 | chr9:115806416 |
| 97 | chr1:89473442 |
| 98 | chr17:55028016 |
| 99 | chr1:240072444 |
| 100 | chr7:108205526 |
| 101 | chr5:35705894 |
| 102 | chr1:109560141 |
| 103 | chr17:4875738 |
| 104 | chr1:35846960 |
| 105 | chr19:1430254 |
| 106 | chr19:48197891 |
| 107 | chr1:237969494 |
| 108 | chr3:122433232 |
| 109 | chr10:90682146 |
| 110 | chr1:24078404 |
| 111 | chr16:4862229 |
| 112 | chr21:34882122 |
| 113 | chr10:64159513 |
| 114 | chrX:13764946 |
| 115 | chr5:147499875 |
| 116 | chr5:147499875 |
| 117 | chr5:147499875 |
| 118 | chr11:71948748 |
| 119 | chr2:172549339 |
| 120 | chr2:37454908 |
| 121 | chr5:36985083 |
| 122 | chrX:154157686 |
| 123 | chr10:29760116 |
| 124 | chr3:41860985 |
| 125 | chr12:416953 |
| 126 | chr1:156642804 |
| 127 | chr4:15067858 |
| 128 | chr15:52901069 |
| 129 | chr6:90432675 |
| 130 | chr4:114823494 |
| 131 | chr1:204924033 |
| 132 | chr2:196788374 |
| 133 | chr6:36867371 |
| 134 | chr16:19722724 |
| 135 | chr7:2968323 |
| 136 | chr4:15995680 |
| 137 | chr2:27248517 |
| 138 | chr11:32635951 |
| 139 | chr9:5968044 |
| 140 | chr12:6924043 |
| 141 | chr5:162917426 |
| 142 | chr2:71191573 |
| 143 | chr19:55815036 |
| 144 | chr13:35733663 |

TABLE 1-continued

For each of the 1087 FSPs, the SEQ ID NO is reported together with the genomic coordinates (hg19 assembly) of the FSM generating the FSP.

| SEQ ID NO | Genomic Coordinate FSM |
|---|---|
| 145 | chr15:81271633 |
| 146 | chr15:55631503 |
| 147 | chr1:147091501 |
| 148 | chr17:26653807 |
| 149 | chr18:45567076 |
| 150 | chr11:107325228 |
| 151 | chr9:136918529 |
| 152 | chr2:97749725 |
| 153 | chr1:151318741 |
| 154 | chr19:50434211 |
| 155 | chr9:131591120 |
| 156 | chr12:88524079 |
| 157 | chr18:46474795 |
| 158 | chr18:46474795 |
| 159 | chr3:180666228 |
| 160 | chr11:16822525 |
| 161 | chr16:89951020 |
| 162 | chr20:50400983 |
| 163 | chr2:103149137 |
| 164 | chr1:150530506 |
| 165 | chr11:118969143 |
| 166 | chr6:160485488 |
| 167 | chr1:25775375 |
| 168 | chr11:4703475 |
| 169 | chr11:75694431 |
| 170 | chr12:123794283 |
| 171 | chr6:15496722 |
| 172 | chr18:21750331 |
| 173 | chr11:31812317 |
| 174 | chr3:57509313 |
| 175 | chr1:40756543 |
| 176 | chr5:179149920 |
| 177 | chr13:33344580 |
| 178 | chr9:18680350 |
| 179 | chr2:54093345 |
| 180 | chr13:34398063 |
| 181 | chr5:176675269 |
| 182 | chr13:27255387 |
| 183 | chr1:49201967 |
| 184 | chr11:111953289 |
| 185 | chr2:234394237 |
| 186 | chr1:100534122 |
| 187 | chr2:44145165 |
| 188 | chr8:74507471 |
| 189 | chr11:71948209 |
| 190 | chr20:23066469 |
| 191 | chr17:40939870 |
| 192 | chr17:76046980 |
| 193 | chr9:34257623 |
| 194 | chr3:182602674 |
| 195 | chr13:53049034 |
| 196 | chr5:143853531 |
| 197 | chr1:203786225 |
| 198 | chr7:91936914 |
| 199 | chr13:109661386 |
| 200 | chr1:169366580 |
| 201 | chr6:101296336 |
| 202 | chr7:102584993 |
| 203 | chr1:1290110 |
| 204 | chr3:77657038 |
| 205 | chr7:1037311 |
| 206 | chr21:33073336 |
| 207 | chr18:12699829 |
| 208 | chr19:12430217 |
| 209 | chrX:48887952 |
| 210 | chr5:130815369 |
| 211 | chr11:47196853 |
| 212 | chr11:47196853 |
| 213 | chr2:148657041 |
| 214 | chrX:302052 |
| 215 | chr6:80751910 |
| 216 | chr8:31001132 |
| 217 | chr9:88937823 |
| 218 | chr9:88937823 |
| 219 | chr1:108700183 |
| 220 | chr16:67645339 |
| 221 | chr10:70156583 |
| 222 | chr11:62381084 |
| 223 | chr6:96999786 |
| 224 | chr6:31323363 |
| 225 | chr3:108229398 |
| 226 | chr17:79803764 |
| 227 | chr22:42564716 |
| 228 | chr20:31022442 |
| 229 | chr2:207174869 |
| 230 | chr3:154032978 |
| 231 | chr1:67390426 |
| 232 | chr20:25422397 |
| 233 | chr16:29825016 |
| 234 | chr21:33074655 |
| 235 | chr6:76599858 |
| 236 | chr6:31504446 |
| 237 | chr7:94185017 |
| 238 | chr2:206166298 |
| 239 | chr2:95815035 |
| 240 | chr17:67125767 |
| 241 | chr10:61823946 |
| 242 | chr2:169699563 |
| 243 | chr7:50531075 |
| 244 | chr1:27106804 |
| 245 | chr20:56227349 |
| 246 | chr20:58452519 |
| 247 | chr12:122720397 |
| 248 | chr7:150698398 |
| 249 | chr16:28883208 |
| 250 | chr11:65836146 |
| 251 | chr15:91304139 |
| 252 | chr3:58089788 |
| 253 | chr9:134007993 |
| 254 | chr20:57769140 |
| 255 | chr10:94243045 |
| 256 | chr13:51530587 |
| 257 | chr10:75560464 |
| 258 | chr11:108216477 |
| 259 | chr22:50898756 |
| 260 | chr17:25910016 |
| 261 | chr11:95555113 |
| 262 | chr11:95555113 |
| 263 | chr18:43459143 |
| 264 | chr11:74336609 |
| 265 | chr12:57921732 |
| 266 | chr2:201436992 |
| 267 | chr9:39073899 |
| 268 | chr19:21992087 |
| 269 | chr6:84634231 |
| 270 | chr20:36361416 |
| 271 | chr12:98921672 |
| 272 | chr14:35585935 |
| 273 | chr1:85331665 |
| 274 | chr2:170665008 |
| 275 | chr6:33178990 |
| 276 | chr12:51392999 |
| 277 | chr4:56765965 |
| 278 | chr16:58589340 |
| 279 | chr11:6662142 |
| 280 | chr15:28200305 |
| 281 | chrX:10188763 |
| 282 | chr4:118005517 |
| 283 | chr2:24086326 |
| 284 | chr19:19906351 |
| 285 | chr2:152112048 |
| 286 | chr5:131944382 |
| 287 | chr11:119213688 |
| 288 | chr19:38028415 |

TABLE 1-continued

For each of the 1087 FSPs, the SEQ ID NO is reported together with the genomic coordinates (hg19 assembly) of the FSM generating the FSP.

| SEQ ID NO | Genomic Coordinate FSM |
|---|---|
| 289 | chr5:57753012 |
| 290 | chr12:49443667 |
| 291 | chr16:15131990 |
| 292 | chr8:22472975 |
| 293 | chrX:56591874 |
| 294 | chr20:18287008 |
| 295 | chr20:18287008 |
| 296 | chr20:18287008 |
| 297 | chr1:1116223 |
| 298 | chr22:46931227 |
| 299 | chr12:95650969 |
| 300 | chr2:240002823 |
| 301 | chr2:175213713 |
| 302 | chr3:195595229 |
| 303 | chr12:57572242 |
| 304 | chr4:3432431 |
| 305 | chr12:27950769 |
| 306 | chr6:107391602 |
| 307 | chr1:16462199 |
| 308 | chr3:169700664 |
| 309 | chr14:93761193 |
| 310 | chr19:6477251 |
| 311 | chr14:52481919 |
| 312 | chr6:109850222 |
| 313 | chr9:138379043 |
| 314 | chr6:13206135 |
| 315 | chr2:196866535 |
| 316 | chr1:27876869 |
| 317 | chr1:247319909 |
| 318 | chr3:50099450 |
| 319 | chr18:29453418 |
| 320 | chr22:43213780 |
| 321 | chr11:58962827 |
| 322 | chr4:153864507 |
| 323 | chr2:86831015 |
| 324 | chr12:57883053 |
| 325 | chr17:73498973 |
| 326 | chr4:164428219 |
| 327 | chr2:197649614 |
| 328 | chr19:38899416 |
| 329 | chr2:1652960 |
| 330 | chr17:16285785 |
| 331 | chr16:77356311 |
| 332 | chr14:102718303 |
| 333 | chr4:170428203 |
| 334 | chr12:58025103 |
| 335 | chr14:31074772 |
| 336 | chr21:33949091 |
| 337 | chr16:66599895 |
| 338 | chr4:170613460 |
| 339 | chr4:170613460 |
| 340 | chr1:36935323 |
| 341 | chr3:15084406 |
| 342 | chr7:158704353 |
| 343 | chr17:28505167 |
| 344 | chr7:115594657 |
| 345 | chr18:10741064 |
| 346 | chr2:99778781 |
| 347 | chr13:114542718 |
| 348 | chr12:31448178 |
| 349 | chr7:91603085 |
| 350 | chr5:35874637 |
| 351 | chr6:80720630 |
| 352 | chr17:7751137 |
| 353 | chr20:45875072 |
| 354 | chr8:67488453 |
| 355 | chr15:62244050 |
| 356 | chr3:48465485 |
| 357 | chr4:2242634 |
| 358 | chr4:107156505 |
| 359 | chr11:61539013 |
| 360 | chr2:152320541 |
| 361 | chr2:201683505 |
| 362 | chr2:201683505 |
| 363 | chr1:65339111 |
| 364 | chr7:92760738 |
| 365 | chr13:95696016 |
| 366 | chr10:13151192 |
| 367 | chr11:125505378 |
| 368 | chr10:115662308 |
| 369 | chr1:68171151 |
| 370 | chr1:155152179 |
| 371 | chr16:88504203 |
| 372 | chr1:19467923 |
| 373 | chr9:37357250 |
| 374 | chr16:88691141 |
| 375 | chr11:32637520 |
| 376 | chr17:63532585 |
| 377 | chr2:210887680 |
| 378 | chr3:57276921 |
| 379 | chr13:32954023 |
| 380 | chr16:9857380 |
| 381 | chr16:30007665 |
| 382 | chr5:72264329 |
| 383 | chr9:131019390 |
| 384 | chr5:43173517 |
| 385 | chr12:102108338 |
| 386 | chr17:67218780 |
| 387 | chr2:201437004 |
| 388 | chr16:3817721 |
| 389 | chr4:40144449 |
| 390 | chr15:59186310 |
| 391 | chr7:150656679 |
| 392 | chr6:74351590 |
| 393 | chr19:18887993 |
| 394 | chr12:56347514 |
| 395 | chr5:60822215 |
| 396 | chr5:140502487 |
| 397 | chr8:133150233 |
| 398 | chr5:137627690 |
| 399 | chr1:10177642 |
| 400 | chr2:71337212 |
| 401 | chr9:17135271 |
| 402 | chr11:17352468 |
| 403 | chr16:53263000 |
| 404 | chr20:37146233 |
| 405 | chrX:153042691 |
| 406 | chr3:142775212 |
| 407 | chr9:115941002 |
| 408 | chr5:96315249 |
| 409 | chr14:92472698 |
| 410 | chr5:109940905 |
| 411 | chr1:158058203 |
| 412 | chr19:58264857 |
| 413 | chr8:124140521 |
| 414 | chr3:133670083 |
| 415 | chr9:69421905 |
| 416 | chr17:7193637 |
| 417 | chr1:62253580 |
| 418 | chr17:33749493 |
| 419 | chr8:70488249 |
| 420 | chr14:65035126 |
| 421 | chr1:113471890 |
| 422 | chr15:91019925 |
| 423 | chr19:7987519 |
| 424 | chr6:52334208 |
| 425 | chr6:90576391 |
| 426 | chr10:131666125 |
| 427 | chr3:167507159 |
| 428 | chr20:40739003 |
| 429 | chr5:137505021 |
| 430 | chr16:29818054 |
| 431 | chr10:116730192 |
| 432 | chr4:160253755 |

TABLE 1-continued

For each of the 1087 FSPs, the SEQ ID NO is reported together with the genomic coordinates (hg19 assembly) of the FSM generating the FSP.

| SEQ ID NO | Genomic Coordinate FSM |
|---|---|
| 433 | chrX:70327614 |
| 434 | chr10:116887435 |
| 435 | chr8:67716612 |
| 436 | chr15:76958036 |
| 437 | chr1:226352491 |
| 438 | chr13:77581683 |
| 439 | chr14:23745310 |
| 440 | chr22:38895455 |
| 441 | chr6:71546674 |
| 442 | chr11:63313709 |
| 443 | chr19:5587282 |
| 444 | chr13:20638677 |
| 445 | chr15:55912892 |
| 446 | chr9:138715800 |
| 447 | chr12:50025258 |
| 448 | chr10:13696452 |
| 449 | chr6:87969484 |
| 450 | chr12:88449444 |
| 451 | chr10:100186987 |
| 452 | chr19:4816465 |
| 453 | chr13:103524612 |
| 454 | chr4:38691476 |
| 455 | chr2:173368931 |
| 456 | chr11:124845049 |
| 457 | chr16:14346300 |
| 458 | chr11:6629392 |
| 459 | chr12:57921401 |
| 460 | chr15:41029894 |
| 461 | chr16:77775744 |
| 462 | chr20:31041556 |
| 463 | chr14:88940113 |
| 464 | chr4:25849258 |
| 465 | chr8:95531563 |
| 466 | chr20:39990829 |
| 467 | chr2:74763924 |
| 468 | chr8:24257686 |
| 469 | chr19:49218106 |
| 470 | chr7:100479332 |
| 471 | chr17:80615786 |
| 472 | chr17:17046886 |
| 473 | chr3:42679486 |
| 474 | chr11:94230059 |
| 475 | chr19:49982166 |
| 476 | chr4:169317264 |
| 477 | chr1:149884981 |
| 478 | chr17:55028118 |
| 479 | chr1:169790867 |
| 480 | chr4:39515753 |
| 481 | chr17:26449740 |
| 482 | chr2:219449364 |
| 483 | chr1:237024474 |
| 484 | chr19:36223002 |
| 485 | chr1:156694023 |
| 486 | chr11:64004663 |
| 487 | chr19:20228702 |
| 488 | chr8:68992721 |
| 489 | chr18:13746253 |
| 490 | chr1:151774033 |
| 491 | chr9:103111633 |
| 492 | chr9:106885501 |
| 493 | chr2:39074185 |
| 494 | chr7:99817848 |
| 495 | chr12:6711546 |
| 496 | chr12:6711546 |
| 497 | chr1:156715104 |
| 498 | chr19:39330959 |
| 499 | chr10:81072446 |
| 500 | chr7:6196443 |
| 501 | chr7:100855927 |
| 502 | chr12:107937778 |
| 503 | chr2:172546762 |
| 504 | chr11:121475905 |
| 505 | chr12:117977605 |
| 506 | chr17:44109601 |
| 507 | chr7:21939669 |
| 508 | chr8:133826909 |
| 509 | chrX:70472854 |
| 510 | chr1:26671971 |
| 511 | chr11:33117910 |
| 512 | chr7:92146721 |
| 513 | chr13:45008838 |
| 514 | chr3:53889347 |
| 515 | chr2:163134716 |
| 516 | chr13:23912864 |
| 517 | chr20:30789952 |
| 518 | chr6:114292040 |
| 519 | chr1:168054869 |
| 520 | chr2:55176077 |
| 521 | chr15:49776644 |
| 522 | chr18:19154750 |
| 523 | chr7:19738024 |
| 524 | chr1:93599280 |
| 525 | chr5:131676327 |
| 526 | chr2:109086477 |
| 527 | chr8:99168468 |
| 528 | chr3:185212518 |
| 529 | chr6:102503432 |
| 530 | chr6:102503432 |
| 531 | chr6:102503432 |
| 532 | chr16:50745399 |
| 533 | chr16:30736371 |
| 534 | chr10:63958149 |
| 535 | chr1:100889837 |
| 536 | chr1:46752129 |
| 537 | chr22:18300932 |
| 538 | chr19:10433828 |
| 539 | chr6:33263965 |
| 540 | chr19:45556129 |
| 541 | chr18:12370885 |
| 542 | chr1:28920547 |
| 543 | chr1:197145703 |
| 544 | chr12:121432118 |
| 545 | chr8:144621235 |
| 546 | chr7:42005573 |
| 547 | chr16:72991758 |
| 548 | chr12:54645832 |
| 549 | chr6:4031881 |
| 550 | chr1:1961598 |
| 551 | chr13:114523858 |
| 552 | chr10:52005194 |
| 553 | chr11:45948373 |
| 554 | chr19:58084579 |
| 555 | chr1:52305912 |
| 556 | chr1:52305912 |
| 557 | chr2:204305619 |
| 558 | chr7:107395909 |
| 559 | chr13:46543661 |
| 560 | chr1:110300580 |
| 561 | chr12:8281937 |
| 562 | chr16:4944500 |
| 563 | chr15:86287017 |
| 564 | chr4:142143532 |
| 565 | chr2:56559113 |
| 566 | chr12:110344435 |
| 567 | chr5:127610311 |
| 568 | chr10:127697969 |
| 569 | chr12:88512305 |
| 570 | chr3:142030643 |
| 571 | chr7:94174999 |
| 572 | chr19:33167776 |
| 573 | chr9:33385690 |
| 574 | chr14:94088050 |
| 575 | chr2:211018375 |
| 576 | chr14:27066542 |

TABLE 1-continued

For each of the 1087 FSPs, the SEQ ID NO is reported together with the genomic coordinates (hg19 assembly) of the FSM generating the FSP.

| SEQ ID NO | Genomic Coordinate FSM |
|---|---|
| 577 | chr10:89717770 |
| 578 | chr2:203168133 |
| 579 | chr12:123351892 |
| 580 | chr1:36636626 |
| 581 | chr4:140291445 |
| 582 | chr13:100925452 |
| 583 | chr13:79918807 |
| 584 | chr16:28909714 |
| 585 | chr4:113570754 |
| 586 | chr5:98206409 |
| 587 | chr12:63541343 |
| 588 | chr2:113060881 |
| 589 | chr1:200822549 |
| 590 | chr12:970297 |
| 591 | chr20:23065992 |
| 592 | chr3:142142409 |
| 593 | chr11:134048586 |
| 594 | chr3:126735391 |
| 595 | chr6:161469776 |
| 596 | chr1:52991780 |
| 597 | chr20:56735727 |
| 598 | chr2:220504282 |
| 599 | chr2:58373509 |
| 600 | chr2:242179467 |
| 601 | chr9:35547974 |
| 602 | chr14:35331423 |
| 603 | chr2:219529514 |
| 604 | chr3:176769342 |
| 605 | chr4:156273869 |
| 606 | chr2:20200211 |
| 607 | chr4:76891521 |
| 608 | chr4:68530907 |
| 609 | chr20:5924808 |
| 610 | chr2:103334978 |
| 611 | chr13:95735432 |
| 612 | chr19:5590343 |
| 613 | chr1:155448996 |
| 614 | chr6:36181729 |
| 615 | chr2:88327536 |
| 616 | chr5:37226878 |
| 617 | chr8:27364393 |
| 618 | chr16:50825519 |
| 619 | chr4:83827648 |
| 620 | chr10:18834895 |
| 621 | chrX:41089035 |
| 622 | chr3:113380090 |
| 623 | chr1:207642044 |
| 624 | chr17:17119709 |
| 625 | chr6:84896233 |
| 626 | chr18:67697249 |
| 627 | chr7:100285170 |
| 628 | chr18:21745097 |
| 629 | chr6:30572795 |
| 630 | chr9:109689491 |
| 631 | chr4:95173910 |
| 632 | chr19:13882968 |
| 633 | chr10:124758127 |
| 634 | chr13:103381996 |
| 635 | chr16:709106 |
| 636 | chr22:41257115 |
| 637 | chr12:40713870 |
| 638 | chr13:23914687 |
| 639 | chr15:44843099 |
| 640 | chr7:29070262 |
| 641 | chr8:124707762 |
| 642 | chr13:114514859 |
| 643 | chr1:35365852 |
| 644 | chr9:35043650 |
| 645 | chr17:46629737 |
| 646 | chr2:227661664 |
| 647 | chr14:89878534 |
| 648 | chr3:168833257 |
| 649 | chr8:6289099 |
| 650 | chr8:105509429 |
| 651 | chr7:120971879 |
| 652 | chr7:2641075 |
| 653 | chr5:140857742 |
| 654 | chr11:34910341 |
| 655 | chr12:4719362 |
| 656 | chr2:132021078 |
| 657 | chr8:70514026 |
| 658 | chr17:25975972 |
| 659 | chr12:124848228 |
| 660 | chr12:124848228 |
| 661 | chr1:228559450 |
| 662 | chr12:110019240 |
| 663 | chr9:90321802 |
| 664 | chr19:42838298 |
| 665 | chr10:64952699 |
| 666 | chr15:59376343 |
| 667 | chr8:144941378 |
| 668 | chr4:38774956 |
| 669 | chr7:22197474 |
| 670 | chr2:71650549 |
| 671 | chr1:91406040 |
| 672 | chr17:44248731 |
| 673 | chr7:44120414 |
| 674 | chr3:141326548 |
| 675 | chr6:116967058 |
| 676 | chr2:220081103 |
| 677 | chr20:17581680 |
| 678 | chr2:128238676 |
| 679 | chr16:28913640 |
| 680 | chr19:17039884 |
| 681 | chr1:153751860 |
| 682 | chr19:50158042 |
| 683 | chr6:99849343 |
| 684 | chr3:42679036 |
| 685 | chr4:39462464 |
| 686 | chr18:54358513 |
| 687 | chr5:61847115 |
| 688 | chr5:76358967 |
| 689 | chr9:35108148 |
| 690 | chr12:20522723 |
| 691 | chr16:71668442 |
| 692 | chr11:88068108 |
| 693 | chr11:88068108 |
| 694 | chr9:84208132 |
| 695 | chr1:100588802 |
| 696 | chr5:38923329 |
| 697 | chr4:38690460 |
| 698 | chr5:131007941 |
| 699 | chr14:75265533 |
| 700 | chr10:62149221 |
| 701 | chr3:169557805 |
| 702 | chr11:35513670 |
| 703 | chr12:113442830 |
| 704 | chr14:95662949 |
| 705 | chr2:219508084 |
| 706 | chr12:117624320 |
| 707 | chr8:72958792 |
| 708 | chr17:38546381 |
| 709 | chr12:75893593 |
| 710 | chr1:170004605 |
| 711 | chr12:122748169 |
| 712 | chr16:88694459 |
| 713 | chr6:4052975 |
| 714 | chr4:128564917 |
| 715 | chr15:69331226 |
| 716 | chr4:76539580 |
| 717 | chr5:13701426 |
| 718 | chr3:89499363 |
| 719 | chr2:170493804 |
| 720 | chr4:170359358 |

TABLE 1-continued

For each of the 1087 FSPs, the SEQ ID NO is reported together with the genomic coordinates (hg19 assembly) of the FSM generating the FSP.

| SEQ ID NO | Genomic Coordinate FSM |
|---|---|
| 721 | chr19:12155504 |
| 722 | chr22:31485922 |
| 723 | chr9:140356679 |
| 724 | chr11:380921 |
| 725 | chr17:61781804 |
| 726 | chr17:61781804 |
| 727 | chr17:61781804 |
| 728 | chr18:45567085 |
| 729 | chr15:28525215 |
| 730 | chr19:7976149 |
| 731 | chr19:7976149 |
| 732 | chr3:33602361 |
| 733 | chr11:45955607 |
| 734 | chr4:186515044 |
| 735 | chr2:176995417 |
| 736 | chr7:128852004 |
| 737 | chr16:30409310 |
| 738 | chr14:75514604 |
| 739 | chr10:17363321 |
| 740 | chr9:21007046 |
| 741 | chr5:154173390 |
| 742 | chr8:24167473 |
| 743 | chr11:64572093 |
| 744 | chr3:194147850 |
| 745 | chr4:1980559 |
| 746 | chr8:6302639 |
| 747 | chr13:73337684 |
| 748 | chr14:100594927 |
| 749 | chr18:40857246 |
| 750 | chr10:103826900 |
| 751 | chr14:20846338 |
| 752 | chr5:72199545 |
| 753 | chr12:49374348 |
| 754 | chr16:24942180 |
| 755 | chr14:105174185 |
| 756 | chr2:203831759 |
| 757 | chr1:7998254 |
| 758 | chr12:57860075 |
| 759 | chr19:12384448 |
| 760 | chr11:9735070 |
| 761 | chr2:10059788 |
| 762 | chr17:73491063 |
| 763 | chr9:33464082 |
| 764 | chr16:71483562 |
| 765 | chr17:61497894 |
| 766 | chr18:13681751 |
| 767 | chr4:2698177 |
| 768 | chr12:53452903 |
| 769 | chr3:25647591 |
| 770 | chr8:39068767 |
| 771 | chr22:33255324 |
| 772 | chr7:151845524 |
| 773 | chr9:135277541 |
| 774 | chr7:33014804 |
| 775 | chr2:99976805 |
| 776 | chr12:54971060 |
| 777 | chr4:26417146 |
| 778 | chr19:36210764 |
| 779 | chr10:91203598 |
| 780 | chr7:102760123 |
| 781 | chr5:68492902 |
| 782 | chr14:55818555 |
| 783 | chr1:46494559 |
| 784 | chr14:96761299 |
| 785 | chr3:26751758 |
| 786 | chr9:6012690 |
| 787 | chr8:100990178 |
| 788 | chr11:27362973 |
| 789 | chr6:17788023 |
| 790 | chr3:37367468 |
| 791 | chr17:18181545 |
| 792 | chr6:42832627 |
| 793 | chr2:99977965 |
| 794 | chr11:102713563 |
| 795 | chr4:3133117 |
| 796 | chr1:153362605 |
| 797 | chrX:133378875 |
| 798 | chr14:105614481 |
| 799 | chr17:19641649 |
| 800 | chr17:40134398 |
| 801 | chr9:19063047 |
| 802 | chr19:45996513 |
| 803 | chr2:231931680 |
| 804 | chr8:30703516 |
| 805 | chr10:91163033 |
| 806 | chr1:89732166 |
| 807 | chr20:2816204 |
| 808 | chr1:89206848 |
| 809 | chr16:53348351 |
| 810 | chr9:90582463 |
| 811 | chr3:38949441 |
| 812 | chr19:48789818 |
| 813 | chr7:89929188 |
| 814 | chr3:195487898 |
| 815 | chr15:42738788 |
| 816 | chr9:95221949 |
| 817 | chr12:117615412 |
| 818 | chr17:73814802 |
| 819 | chr1:12052736 |
| 820 | chr11:65653077 |
| 821 | chrX:131762582 |
| 822 | chr12:57921002 |
| 823 | chr20:36627613 |
| 824 | chr11:970195 |
| 825 | chr6:30157254 |
| 826 | chr1:230798959 |
| 827 | chr12:12814274 |
| 828 | chr10:129913974 |
| 829 | chr9:124536637 |
| 830 | chr11:104874011 |
| 831 | chr5:1074698 |
| 832 | chr15:72190580 |
| 833 | chr17:38552642 |
| 834 | chr1:35370731 |
| 835 | chr9:135277388 |
| 836 | chr15:75499804 |
| 837 | chr3:54596940 |
| 838 | chr9:125861042 |
| 839 | chr8:92352747 |
| 840 | chr11:111896977 |
| 841 | chr2:160604680 |
| 842 | chr11:111904183 |
| 843 | chr18:265348 |
| 844 | chr18:45566519 |
| 845 | chr2:225738848 |
| 846 | chr4:129869675 |
| 847 | chr9:139945517 |
| 848 | chr3:121573659 |
| 849 | chr9:35091693 |
| 850 | chr4:122723894 |
| 851 | chr15:57489984 |
| 852 | chr19:50333113 |
| 853 | chr11:6292451 |
| 854 | chr15:49309051 |
| 855 | chr7:140482927 |
| 856 | chr7:126173278 |
| 857 | chr3:182987674 |
| 858 | chr2:190626331 |
| 859 | chr8:145150876 |
| 860 | chr2:16082314 |
| 861 | chr8:113241029 |
| 862 | chr12:7310658 |
| 863 | chr9:98209617 |
| 864 | chr17:46135788 |

TABLE 1-continued

For each of the 1087 FSPs, the SEQ ID NO is reported together with the genomic coordinates (hg19 assembly) of the FSM generating the FSP.

| SEQ ID NO | Genomic Coordinate FSM |
|---|---|
| 865 | chr14:74967607 |
| 866 | chr17:7496122 |
| 867 | chr16:1270496 |
| 868 | chr3:169802469 |
| 869 | chr7:47955186 |
| 870 | chr6:34839369 |
| 871 | chr12:72038781 |
| 872 | chr7:86978480 |
| 873 | chr7:86978480 |
| 874 | chr13:60582734 |
| 875 | chr6:90415853 |
| 876 | chr6:111498763 |
| 877 | chr5:125939712 |
| 878 | chr22:32794006 |
| 879 | chr19:38102620 |
| 880 | chr20:47989891 |
| 881 | chr7:100028068 |
| 882 | chr1:53543377 |
| 883 | chr3:150289746 |
| 884 | chr17:54921519 |
| 885 | chr5:137803132 |
| 886 | chr11:69063724 |
| 887 | chr2:42488302 |
| 888 | chr12:122018740 |
| 889 | chr14:104642560 |
| 890 | chr15:23890894 |
| 891 | chr17:56448298 |
| 892 | chr16:15131931 |
| 893 | chr2:43452512 |
| 894 | chr12:7173239 |
| 895 | chr2:149447829 |
| 896 | chr12:80201042 |
| 897 | chr12:80201042 |
| 898 | chr12:104476535 |
| 899 | chr17:4837373 |
| 900 | chr7:107763584 |
| 901 | chr7:139833448 |
| 902 | chr12:77449827 |
| 903 | chr6:112389434 |
| 904 | chr8:90967512 |
| 905 | chr10:27322259 |
| 906 | chr2:55138130 |
| 907 | chr16:74976691 |
| 908 | chr15:49036443 |
| 909 | chr21:34799292 |
| 910 | chrX:63412648 |
| 911 | chr12:19514518 |
| 912 | chr3:160143940 |
| 913 | chr12:131283100 |
| 914 | chr12:131283100 |
| 915 | chr2:220502413 |
| 916 | chr15:55759242 |
| 917 | chr10:91359120 |
| 918 | chr2:236649677 |
| 919 | chr16:31151942 |
| 920 | chr10:135111566 |
| 921 | chr10:96352051 |
| 922 | chr4:87769943 |
| 923 | chr1:215793922 |
| 924 | chr15:53908071 |
| 925 | chr15:34444996 |
| 926 | chr7:104746985 |
| 927 | chr16:11141159 |
| 928 | chr19:5667115 |
| 929 | chrX:53112052 |
| 930 | chr17:28296061 |
| 931 | chr1:35578941 |
| 932 | chr9:114695180 |
| 933 | chr1:214830653 |
| 934 | chr7:25200833 |
| 935 | chr8:86114461 |
| 936 | chr1:231487256 |
| 937 | chr12:99071207 |
| 938 | chrX:99854070 |
| 939 | chr14:54896992 |
| 940 | chr11:65314283 |
| 941 | chr11:75905667 |
| 942 | chrX:21675046 |
| 943 | chr19:16314384 |
| 944 | chr19:16314384 |
| 945 | chr15:101438350 |
| 946 | chr11:400077 |
| 947 | chr19:42383610 |
| 948 | chr19:39663913 |
| 949 | chr1:149895562 |
| 950 | chr5:108290522 |
| 951 | chrX:19560215 |
| 952 | chr18:31319986 |
| 953 | chr16:30041821 |
| 954 | chr5:140953309 |
| 955 | chr2:169997025 |
| 956 | chr22:41195058 |
| 957 | chr22:41195058 |
| 958 | chr19:36357214 |
| 959 | chr12:130184705 |
| 960 | chr8:37728933 |
| 961 | chr2:26534413 |
| 962 | chr1:156884483 |
| 963 | chr11:64032517 |
| 964 | chr19:52888438 |
| 965 | chr14:75230947 |
| 966 | chr2:203848308 |
| 967 | chr8:32453511 |
| 968 | chr7:97933623 |
| 969 | chr2:169948389 |
| 970 | chr1:206821441 |
| 971 | chr16:84213651 |
| 972 | chr7:154782740 |
| 973 | chr4:153244156 |
| 974 | chr3:126142183 |
| 975 | chrX:54497148 |
| 976 | chr11:118770652 |
| 977 | chr18:30349862 |
| 978 | chr12:42706971 |
| 979 | chr2:196801374 |
| 980 | chr8:124368685 |
| 981 | chr13:31480852 |
| 982 | chr6:18122226 |
| 983 | chr3:71821968 |
| 984 | chr4:71844995 |
| 985 | chr2:159077217 |
| 986 | chr19:47969003 |
| 987 | chr22:50277679 |
| 988 | chr12:88566417 |
| 989 | chr8:53062482 |
| 990 | chr10:93247481 |
| 991 | chr5:13766239 |
| 992 | chr9:32633025 |
| 993 | chr11:73021527 |
| 994 | chr1:178412041 |
| 995 | chr16:27509009 |
| 996 | chr15:85634360 |
| 997 | chr16:31373986 |
| 998 | chr19:35435665 |
| 999 | chr6:126176317 |
| 1000 | chr10:32311826 |
| 1001 | chr6:71235776 |
| 1002 | chr4:37447379 |
| 1003 | chr6:45390355 |
| 1004 | chr2:157185029 |
| 1005 | chr14:50930796 |
| 1006 | chr7:91732039 |
| 1007 | chr4:47939172 |
| 1008 | chr10:27329038 |

TABLE 1-continued

For each of the 1087 FSPs, the SEQ ID NO is reported together with the genomic coordinates (hg19 assembly) of the FSM generating the FSP.

| SEQ ID NO | Genomic Coordinate FSM |
|---|---|
| 1009 | chr1:229422305 |
| 1010 | chr6:76423416 |
| 1011 | chr1:154932028 |
| 1012 | chr13:108518338 |
| 1013 | chr9:20912931 |
| 1014 | chr8:125080031 |
| 1015 | chr5:14487781 |
| 1016 | chr1:154942911 |
| 1017 | chr3:63981832 |
| 1018 | chr17:4575894 |
| 1019 | chr12:39734129 |
| 1020 | chr12:29450110 |
| 1021 | chr11:66055105 |
| 1022 | chr11:66055105 |
| 1023 | chr11:108044069 |
| 1024 | chr12:6657974 |
| 1025 | chr5:41181560 |
| 1026 | chr19:11577605 |
| 1027 | chr7:44684936 |
| 1028 | chr1:8716109 |
| 1029 | chr13:50065970 |
| 1030 | chr5:180432665 |
| 1031 | chr14:100728644 |
| 1032 | chr8:145727027 |
| 1033 | chr7:105655642 |
| 1034 | chr4:8616156 |
| 1035 | chr2:110926098 |
| 1036 | chr11:82877219 |
| 1037 | chr8:145065718 |
| 1038 | chr1:55081757 |
| 1039 | chr19:14593640 |
| 1040 | chr17:2579802 |
| 1041 | chr2:230661315 |
| 1042 | chr3:40529660 |
| 1043 | chr9:123954450 |
| 1044 | chr9:125141077 |
| 1045 | chr10:115481532 |
| 1046 | chr10:91514406 |
| 1047 | chr8:92406218 |
| 1048 | chr21:37605286 |
| 1049 | chr20:44050026 |
| 1050 | chr8:68128856 |
| 1051 | chr5:132534817 |
| 1052 | chr15:65994675 |
| 1053 | chr22:42610948 |
| 1054 | chr19:17836781 |
| 1055 | chr8:55538813 |
| 1056 | chr1:233388513 |
| 1057 | chr1:38274674 |
| 1058 | chr4:678571 |
| 1059 | chr4:678571 |
| 1060 | chr7:23775341 |
| 1061 | chr20:62193251 |
| 1062 | chr11:1902786 |
| 1063 | chr1:179337955 |
| 1064 | chr1:192779369 |
| 1065 | chr4:74313372 |
| 1066 | chr4:110756541 |
| 1067 | chr8:27634577 |
| 1068 | chr14:24032654 |
| 1069 | chr6:144086414 |
| 1070 | chr19:50098808 |
| 1071 | chr10:105363391 |
| 1072 | chr16:88504852 |
| 1073 | chr2:97637864 |
| 1074 | chr15:63986203 |
| 1075 | chr11:118402960 |
| 1076 | chr2:241808308 |
| 1077 | chr6:29641359 |
| 1078 | chr8:145773375 |
| 1079 | chr11:17794004 |
| 1080 | chr12:57704152 |
| 1081 | chr5:56219767 |
| 1082 | chr19:33703794 |
| 1083 | chr8:26221272 |
| 1084 | chr16:25232875 |
| 1085 | chr7:4830445 |
| 1086 | chr6:86275080 |
| 1087 | chr19:46025663 |

Example 3: Selection of an Optimal Subset of FSPs for an MSI Vaccine with High "Immunogenic Coverage"

SEQ ID NOs: 1 to 1087 indicate the amino acid sequence of FSPs and mFSPs that may be included in a CVP of the present invention. This exemplary CFSP comprises 1087 FSPs and mFSPs. If the criterions outlined in Example 1 and 2 are altered the CFSP will include additional or fewer FSPs and, accordingly the CVP will include additional or fewer FSPs and mFSPs. Depending on the way of administering the CVP, e.g. viral vector, naked DNA/RNA, it may not be practical or economical to generate CVPs of such a large number of FSPs and mFSPs. Thus, the present inventors have developed further selection criteria to select from a CFSP generated as outlined in Examples 1 and 2 a suitable number of FSPs or of mFSPs derived from FSPs of the CFSP to be included in the CVP to attain an optimal immunization of the majority of patients afflicted with a particular MSI cancer or optimal prophylaxis in patients likely to develop a MSI cancer. In the following such additional selection criteria which the present inventors used to determine subsets of FSPs and mFSPs to be included in preferred CVPs are described.

In previous studies in human subjects vaccinated with different viral antigens have shown that an antigenic sequence of about 400 aa contains on average 3 immunogenic epitopes (min 1, max 12) (FIG. 1) (Borthwick, N., et al. (2017) PLoS One 12(4), Swadling, L., et al. (2014) Sci Transl Med 6(261)). Therefore, to obtain a good "immunogenic coverage", that is here intended as an expected average of 3 immunogenic epitopes, it would be desirable that the FSPs selected for the vaccine were represented in each patient's tumor for a total length of at least 400 aa. Thus, the present inventors have developed an algorithm to select FSPs from the CFSP in a way that the empirically established minimal immunogenic coverage threshold of 400 aa was reached for the maximum number of MSI tumors examined. Whenever feasible, the present inventors aimed at reaching a target immunogenic coverage of 800 aa to compensate for the possibility that a proportion of the FSPs were not translated or presented on tumor cells. These criteria should ensure: (i) a high probability to induce effective immune responses in a large cohort of patients; and (ii) that a large number of cancer cells within a given patient will be targeted by vaccine-induced immunity.

An additional constrain was imposed in the algorithm to achieve a maximal total length of 6000 aa for all FSPs in the final vaccine set. This length cutoff reflected a preferred total number of vaccine vectors (n=4) given the maximal insert size of about 4.500 nucleotides per vector encoding about ~1500 aa of continuous joined FSPs and/or mFSPs.

For each of the 1059 FSMs generating the FSPs in the CVSP collection, a value of 1 or zero was attributed based on the presence or absence of the FSM, respectively, in each of the 320 TCGA MSI tumors (69 MSI-H colorectal cancer, 85 MSI gastric cancer and 166 MSI endometrial cancer). For each tumor type, FSMs with a frequency <5% were assigned a value of zero to favor the inclusion in the vaccine list of those FSMs that are more shared within each tumor group.

As a first step, the algorithm ranked the 1059 FSMs according to a score that is the product between the total length of all FSPs generated by each FSM and the FSM's observed frequency across the 320 MSI tumors (aa length x number of samples containing the FSM/total samples).

The first FSM included in the vaccine list was the one with the highest score. Subsequently, the algorithm proceeded in a cyclic manner, by selecting at each round the FSM that enabled the maximal number of tumors to increase their immunogenic coverage. If more than one FSM fulfilled this condition, the FSM with the highest score was chosen. When an FSM was selected, all FSPs encoded by that FSM were added to the vaccine list and the immunogenic coverage of the samples carrying the selected FSM was updated accordingly by adding the total aa length of the corresponding FSPs. Once a sample reached the target immunogenic coverage threshold (in the present case selected to be 800 aa for colorectal and gastric cancer, 400 aa for endometrial cancer), the algorithm discounted it for the selection of subsequent FSMs, while only taking into account those samples that had yet to reach the target coverage.

The algorithm continued to add FSPs or mFSPs to the vaccine list, i.e. the amino acid sequences forming the CVP, until one of the three following conditions was fulfilled: (i) the total aa length of all selected FSPs encoded by the selected FSMs superseded 6000aa; (ii) all cancer samples had an immunogenic coverage≥the target threshold or (iii) there were no more FSMs that increased the immunogenic coverage of the samples below the threshold.

The final subset of FSPs selected with the described algorithm comprises 209 FSPs arising from 204 FSMs for a total length of 6021aa and is referred to as Nous-209 (SEQ ID NO: 1 to 209). This subset of FSPs provides immunogenic coverage≥400 aa for 98% of TCGA colorectal cancer samples with a median number of 50 FSPs per sample and a median immunogenic coverage of 1322 aa. Similarly, FSPs in Nous-209 confer an immunogenic coverage≥400 aa in 95% of the gastric cancer samples with a median number of 46 FSPs per sample and a median coverage of 1178 aa. Finally, immunogenic coverage≥400 aa is reached by 70% of TCGA endometrial cancer, with a median number of 21 FSPs per sample and median coverage of 512 aa. The immunogenic coverage remains very high for colorectal cancer and gastric cancer (93% and 83%, respectively) when calculated for the target value of 800 aa.

Example 4: Validation of Nous-209 as a Candidate MSI Cancer Vaccine with High Immunogenic Coverage As a first validation step for the list of FSPs and mFSPs included in Nous-209, the inventors performed next-generation sequencing (NGS) on a panel of MSI cell lines (7 CRC and 1 EC). At the genomic level (exome-sequencing), the number of FSMs detected in each cell line that were also included in Nous-209 was such that all cell lines overcame significantly the minimal immunogenic coverage threshold of 400 aa, with an average coverage (FSPs cumulative length) of 2037 aa (FIG. 2A).

Secondly, the inventors analyzed the same cell lines by RNA-seq to determine how many FSMs in Nous-209 that were detected by exome sequencing were also expressed at the transcriptional level. Notably, an immunogenic coverage above 400aa was maintained for all cell lines at the RNA-seq level as well (FIG. 2B).

Similar results to those obtained for the MSI cell lines were obtained by exome sequencing of six fresh frozen MSI colorectal cancer matched biopsies (tumor and normal tissue). For all patients analyzed, the immunogenic coverage was higher than the minimal threshold of 400 aa, with an average coverage of 926 aa. Four out of six samples exceeded the target threshold of 800 aa (FIG. 3).

Moreover, to estimate the immunogenicity potential of Nous-209, the inventors calculated how many of the vaccine-encoded FSPs in MSI CRC biopsies were predicted to generate epitopes with a good binding profile ($IC_{50} \leq 500$ nM) to MHC-I molecules. To this aim, the inventors first derived the HLA haplotype of the 6 patients from the sequencing data of their biopsies. Subsequently, the inventors performed HLA-I-matched patient-specific binding predictions on the subset of vaccine-encoded FSPs present in each patient using the IEDB software (http://www.iedb.org/). Each MSI patient had on average 67 epitopes (min 29, max 141) predicted to bind their own HLA-I haplotype (FIG. 4).

Taken together, these results demonstrate that high immunogenic coverage can be achieved through a subset of FSPs, like the subset included in Nous-209 both in MSI cell lines and primary tumor biopsies.

The inventors then verified whether immunogenic responses against FSPs in Nous-209 could be measured in vivo. To this aim, the inventors immunized HLA-A02$^+$ transgenic mice with a subset of Nous-209 FSPs. Vaccine-induced immune responses were evaluated by cytofluorimetry (FACS) using nonamers selected from those FSPs based on binding prediction to HLA-A02. FIG. 5 shows representative CD8 T cell responses to an HLA-A02 nonamer derived from the FSP corresponding to SEQ ID NO: 123 in 5 animals, as measured by intracellular staining (ICS) for interferon γ (IFN-γ) (panel A). FACS plot of gating strategy for IFN-γ$^+$ CD8 T cells from one of those mice are depicted in panel B, showing a significant percentage (5.6%) of FSP-reactive T cells.

Example 5: Construction of Nucleic Acid Cassettes for Nous-209

The FSPs in Nous-209 were split into 4 subsets to generate artificial genes of a length of about 4500 nucleotides, each encoding about 1500 aa suitable for cloning into the following viral backbones: Great Apes Adenovirus (GAd) and Modified Vaccinia Ankara (MVA). Each gene was assembled by joining the FSP sequences one after the other without any linker. The 209 FSPs were distributed across the 4 genes in a way to ensure that each gene would contain approximately the same number of FSPs with similar rank levels according to the algorithm described in Example 3 and would contain FSPs where the corresponding FSMs have a similar overall distribution of observed frequencies across the three cancer types. This procedure resulted in:

Gene 1=1507aa (46 FSPs)
Gene 2=1501aa (54 FSPs)
Gene 3=1506aa (59 FSPs)
Gene 4=1507aa (51 FSPs).

Each artificial gene was assembled in four different layouts (A, B, C and D) corresponding to a different order of the FSPs (Table 2). Genes in layout A and C were used to construct GAd vectors, while genes in layout B and D were cloned in MVA backbones, based on a heterologous prime-boost vaccination strategy. The scrambling of FSPs between layouts A and B and between layouts C and D was designed to avoid having both GAd and MVA encoding the same junctional aa sequences between adjacent FSPs, which could boost immune responses against junctional epitopes. To choose the order of FSPs for each gene in the two layouts, the inventors used a procedure that generates 50,000 different polypeptides where FSPs are joined in random order. Out of these, the inventors selected two with different junctions and with a disordered sequence in the first 50 aa (mean disorder tendency>0.50, as estimated by the IUPRED software (Dosztányi Z., et al. (2005) Bioinformatics 21, 3433) (FIG. 6). The latter choice was based on the notion that a disordered N-terminus favours processing by the proteasome and, therefore, should increase the chances of presentation of FSP-derived epitopes on MHC-I molecules. Subsequently, the artificial polypeptides were screened in silico for similarity to human reference proteins to avoid generation of regions cross-reactive with the human proteome. The aa sequences of the four poly-FSP strings in layouts A, B, C and D are listed as SEQ ID NO: 1088 to 1091 (layout A), SEQ ID NO: 1092 to 1095 (layout B), SEQ ID NO: 1155 to 1158 (layout C) and SEQ ID NO: 1159 to 1162 (layout D) corresponding to a different order of the FSPs (Table 2). Genes in layout A and C were used to construct GAd vectors, while genes in layout B and D were cloned in MVA backbones, based on a heterologous prime-boost vaccination strategy. The scrambling of FSPs between layouts A and B and between layouts C and D was designed respectively. Their corresponding nt sequences are SEQ ID NO: 1096 to 1099 (layout A), SEQ ID NO: 1100 to 1103 (layout B), SEQ ID NO: 1163 to 1166 (layout C) and SEQ ID NO: 1167 to 1170 (layout D).

In order to construct an expression cassette, a sorting signal (either the human tissue plasminogen activator signal peptide (hTPA; SEQ ID NO: 1104) or the human invariant chain (hINV; SEQ ID NO: 1105) was added at the N-terminus and an influenza HA-tag sequence (SEQ ID NO: 1106) at the C-terminus of each polypeptide sequence (FIG. 7). The extended sequence of the so constructed polypeptides is provided as SEQ ID NO: 1107 to 1110 (layout A), SEQ ID NO: 1111 to 1114 (layout B), SEQ ID NO: 1171 to 1174 (layout C) and SEQ ID NO: 1179 to 1182 (layout D) for hTPA and by SEQ ID NO: 1115 to 1118 (layout A), SEQ ID NO: 1119 to 1122 (layout B), SEQ ID NO: 1175 to 1178 (layout C) and SEQ ID NO: 1183 to 1186 (layout D) for hINV. The corresponding nt sequences to generate the indicated poly-FSPs strings were codon-optimized based on human codon usage (SEQ ID NO: 1123 to 1126 for layout A, SEQ ID NO: 1127 to 1130 for layout B, SEQ ID NO: 1187 to 1190 for layout C and SEQ ID NO: 1191 to 1194 for layout D with hTPA; SEQ ID NO: 1131 to 1134 for layout A, SEQ ID NO: 1135 to 1138 for layout B, SEQ ID NO: 1195 to 1198 for layout C and SEQ ID NO: 1199 to 1202 for layout D with hINV). In addition, a Kozak sequence (CGCGACTTCGCCGCC (SEQ ID NO: 1220)) was placed immediately upstream of the start codon to allow for efficient initiation of translation and a TAA stop codon was placed downstream of the HA tag. Finally, two flanking segments comprising unique restriction sites to facilitate the sub-cloning of the cassettes were added at the 5'- and 3'-end of the nucleotide sequence, respectively (FIG. 7). The nt sequences representing the artificial genes (SEQ ID NO: 1139 to 1142 for layout A, SEQ ID NO: 1143 to 1146 for layout B, SEQ ID NO: 1203 to 1206 for layout C and SEQ ID NO: 1207 to 1210 for layout D with hTPA; SEQ ID NO: 1147 to 1150 for layout A, SEQ ID NO: 1151 to 1154 for layout B, SEQ ID NO: 1211 to 1214 for layout C and SEQ ID NO: 1215 to 1218 for layout D with hINV) were generated by standard oligonucleotide synthesis methods and sub-cloned between the TetO-CMV promoter (hCMV promoter with binding site for the Tet Repressor) and the BGH (Bovine growth hormone) polyA.

TABLE 2

FSP composition of the assembled polypeptides for Gene1, Gene2, Gene3 and Gene4 in layout A, B, C and D. In each case the SEQ ID NOs of the FSPs are listed based on their position in the assembled polypeptide (from the N-terminus to the C terminus).

| 1A | 2A | 3A | 4A | 1B | 2B | 3B | 4B | 1C | 2C | 3C | 4C | 1D | 2D | 3D | 4D |
|---|---|---|---|---|---|---|---|---|---|---|---|---|---|---|---|
| 58 | 183 | 135 | 57 | 58 | 183 | 135 | 57 | 70 | 11 | 126 | 128 | 55 | 183 | 139 | 161 |
| 93 | 103 | 172 | 113 | 18 | 92 | 49 | 177 | 58 | 39 | 49 | 161 | 42 | 100 | 184 | 73 |
| 178 | 92 | 40 | 9 | 51 | 100 | 172 | 113 | 42 | 150 | 184 | 177 | 149 | 11 | 125 | 54 |
| 18 | 106 | 139 | 25 | 174 | 71 | 8 | 78 | 118 | 100 | 8 | 148 | 87 | 199 | 206 | 67 |
| 180 | 100 | 168 | 54 | 127 | 79 | 147 | 148 | 110 | 90 | 135 | 83 | 74 | 150 | 209 | 177 |
| 129 | 3 | 8 | 155 | 141 | 194 | 44 | 33 | 1 | 35 | 125 | 50 | 1 | 187 | 208 | 33 |
| 63 | 199 | 126 | 121 | 55 | 187 | 197 | 21 | 102 | 162 | 152 | 169 | 14 | 47 | 176 | 5 |
| 102 | 86 | 192 | 128 | 14 | 52 | 107 | 161 | 145 | 59 | 36 | 54 | 170 | 159 | 160 | 89 |
| 87 | 195 | 91 | 82 | 118 | 23 | 156 | 17 | 149 | 43 | 197 | 13 | 63 | 117 | 107 | 140 |

TABLE 2-continued

FSP composition of the assembled polypeptides for Gene1, Gene2, Gene3 and Gene4 in layout A, B, C and D. In each case the SEQ ID NOs of the FSPs are listed based on their position in the assembled polypeptide (from the N-terminus to the C terminus).

| 1A | 2A | 3A | 4A | 1B | 2B | 3B | 4B | 1C | 2C | 3C | 4C | 1D | 2D | 3D | 4D |
|---|---|---|---|---|---|---|---|---|---|---|---|---|---|---|---|
| 42 | 47 | 143 | 189 | 102 | 3 | 204 | 165 | 182 | 203 | 160 | 57 | 101 | 167 | 16 | 157 |
| 166 | 154 | 49 | 193 | 1 | 19 | 139 | 181 | 101 | 31 | 32 | 37 | 70 | 116 | 99 | 108 |
| 101 | 7 | 131 | 140 | 10 | 195 | 137 | 45 | 166 | 71 | 95 | 140 | 102 | 35 | 32 | 181 |
| 22 | 15 | 95 | 205 | 62 | 117 | 176 | 193 | 186 | 75 | 68 | 113 | 22 | 124 | 147 | 155 |
| 30 | 123 | 202 | 61 | 22 | 94 | 28 | 54 | 2 | 7 | 53 | 205 | 26 | 109 | 156 | 169 |
| 2 | 194 | 60 | 5 | 170 | 154 | 208 | 157 | 18 | 195 | 192 | 17 | 18 | 75 | 188 | 121 |
| 51 | 115 | 80 | 153 | 74 | 179 | 80 | 136 | 55 | 123 | 12 | 108 | 182 | 142 | 91 | 50 |
| 151 | 138 | 107 | 148 | 166 | 7 | 202 | 37 | 190 | 207 | 107 | 77 | 118 | 207 | 4 | 77 |
| 145 | 117 | 99 | 97 | 145 | 106 | 188 | 155 | 141 | 167 | 209 | 89 | 30 | 115 | 168 | 144 |
| 127 | 159 | 24 | 161 | 66 | 199 | 184 | 89 | 93 | 199 | 28 | 136 | 114 | 162 | 48 | 104 |
| 62 | 116 | 197 | 33 | 93 | 146 | 88 | 29 | 34 | 116 | 84 | 132 | 133 | 203 | 172 | 82 |
| 186 | 150 | 20 | 13 | 186 | 86 | 76 | 25 | 10 | 47 | 98 | 165 | 66 | 195 | 68 | 148 |
| 74 | 167 | 81 | 21 | 114 | 15 | 200 | 50 | 129 | 94 | 139 | 29 | 38 | 71 | 36 | 132 |
| 70 | 79 | 28 | 29 | 110 | 159 | 32 | 173 | 66 | 86 | 176 | 67 | 145 | 130 | 40 | 113 |
| 14 | 179 | 152 | 177 | 42 | 167 | 40 | 205 | 127 | 142 | 196 | 155 | 51 | 7 | 49 | 153 |
| 133 | 109 | 160 | 37 | 46 | 35 | 60 | 69 | 30 | 194 | 44 | 5 | 129 | 31 | 76 | 65 |
| 46 | 27 | 164 | 41 | 87 | 116 | 4 | 67 | 85 | 52 | 131 | 158 | 166 | 59 | 95 | 165 |
| 38 | 43 | 206 | 67 | 34 | 142 | 131 | 153 | 105 | 79 | 201 | 73 | 34 | 123 | 200 | 189 |
| 174 | 35 | 204 | 50 | 178 | 124 | 20 | 120 | 14 | 154 | 204 | 185 | 190 | 92 | 204 | 61 |
| 141 | 52 | 188 | 69 | 30 | 198 | 201 | 108 | 151 | 163 | 206 | 153 | 174 | 79 | 53 | 9 |
| 66 | 142 | 53 | 108 | 38 | 123 | 119 | 158 | 180 | 117 | 156 | 61 | 85 | 86 | 60 | 120 |
| 149 | 162 | 208 | 73 | 2 | 43 | 160 | 97 | 114 | 106 | 16 | 189 | 110 | 163 | 131 | 41 |
| 190 | 163 | 209 | 77 | 129 | 130 | 24 | 128 | 87 | 138 | 168 | 82 | 105 | 90 | 119 | 45 |
| 1 | 94 | 12 | 78 | 105 | 150 | 168 | 41 | 174 | 130 | 164 | 25 | 58 | 52 | 175 | 17 |
| 110 | 203 | 44 | 83 | 133 | 162 | 125 | 73 | 63 | 179 | 64 | 181 | 127 | 103 | 112 | 193 |
| 55 | 75 | 137 | 89 | 182 | 191 | 196 | 144 | 38 | 146 | 208 | 121 | 46 | 179 | 143 | 69 |
| 10 | 11 | 36 | 96 | 85 | 115 | 91 | 82 | 46 | 187 | 72 | 69 | 2 | 198 | 192 | 37 |
| 118 | 59 | 196 | 104 | 180 | 39 | 95 | 83 | 51 | 27 | 99 | 78 | 178 | 111 | 24 | 25 |
| 85 | 23 | 48 | 45 | 70 | 207 | 81 | 132 | 170 | 124 | 188 | 157 | 10 | 43 | 126 | 83 |
| 114 | 124 | 64 | 120 | 26 | 56 | 12 | 189 | 22 | 15 | 20 | 144 | 151 | 27 | 20 | 57 |
| 170 | 56 | 72 | 65 | 149 | 109 | 164 | 104 | 62 | 92 | 147 | 9 | 62 | 194 | 28 | 185 |
| 182 | 198 | 156 | 132 | 63 | 111 | 175 | 13 | 133 | 103 | 112 | 96 | 93 | 19 | 98 | 96 |
| 26 | 191 | 98 | 136 | 151 | 103 | 98 | 77 | 178 | 3 | 60 | 41 | 6 | 146 | 202 | 205 |
| 105 | 19 | 76 | 144 | 101 | 75 | 206 | 9 | 6 | 111 | 137 | 65 | 180 | 15 | 152 | 29 |
| 6 | 130 | 119 | 157 | 190 | 47 | 143 | 185 | 26 | 171 | 4 | 45 | 141 | 134 | 197 | 21 |
| 34 | 187 | 147 | 158 | 6 | 138 | 209 | 121 | 74 | 23 | 48 | 33 | 186 | 23 | 88 | 128 |
|  | 146 | 125 | 165 |  | 90 | 99 | 169 |  | 115 | 80 | 193 |  | 154 | 201 | 78 |
|  | 71 | 176 | 17 |  | 27 | 72 | 65 |  | 109 | 172 | 21 |  | 39 | 72 | 173 |
|  | 90 | 84 | 169 |  | 134 | 16 | 96 |  | 183 | 202 | 120 |  | 56 | 12 | 158 |
|  | 207 | 200 | 173 |  | 203 | 36 | 5 |  | 191 | 76 | 104 |  | 106 | 81 | 136 |
|  | 171 | 88 | 181 |  | 171 | 122 | 61 |  | 56 | 122 | 173 |  | 171 | 137 | 97 |
|  | 111 | 112 | 185 |  | 163 | 126 | 140 |  | 134 | 40 | 97 |  | 138 | 164 | 13 |
|  | 134 | 184 |  |  | 59 | 112 |  |  | 19 | 200 |  |  | 191 | 135 |  |
|  | 39 | 4 |  |  | 11 | 192 |  |  | 198 | 175 |  |  | 94 | 84 |  |
|  | 31 | 68 |  |  | 31 | 84 |  |  | 159 | 88 |  |  | 3 | 122 |  |
|  |  | 122 |  |  |  | 152 |  |  |  | 91 |  |  |  | 8 |  |
|  |  | 32 |  |  |  | 53 |  |  |  | 119 |  |  |  | 44 |  |
|  |  | 201 |  |  |  | 64 |  |  |  | 143 |  |  |  | 196 |  |
|  |  | 16 |  |  |  | 68 |  |  |  | 24 |  |  |  | 64 |  |
|  |  | 175 |  |  |  | 48 |  |  |  | 81 |  |  |  | 80 |  |

Example 6: Confirmation of Immunogenicity

The immunogenicity of the 4 GAd vectors (GAd20-209-FSPs) containing the 4 genes in layout A (polypeptide sequence SEQ ID NO: 1107 to 1110, nucleotide sequence SEQ ID NO: 1139 to 1142) and the 4 MVA vectors (MVA-209-FSPs) containing the 4 genes in layout B (polypeptide sequence SEQ ID NO: 1111 to 1114, nucleotide sequence SEQ ID NO: 1143 to 1146) has been evaluated in mice (CB6F1 mouse strain). GAd20-209-FSPs were constructed from GAd20 (SEQ ID NO: 1219) deleted for region E3 and with region E1 substituted by the genes. Mice were immunized by a single intramuscular immunization of GAd20-209-FSPs at doses of 10^8 viral particles (vp) for each vector and two weeks later were boosted by MVA-209-FSPs at doses of 10^7 plaque forming units (pfu). Induction of T-cell responses against vaccine-encoded FSPs was measured by ELIspot assay using synthetic peptides covering the 209 FSPs sequences. Synthetic peptides were diluted in DMSO and mixed to form 16 pools. Immune responses (number of T cells producing Interferon-gamma (IFN-γ) per million splenocytes) were analyzed 2 weeks post prime and one-week post boost. Data show induction of a T-cell mediated immune response after priming with GAd20-209-FSPs and a powerful boost of the immune response obtained after administration of MVA-209-FSPs (FIG. 8). Responses were directed to multiple FSPs distributed over the vaccine constructs as they were detected against each of the 16 peptides pools (FIG. 9). Importantly, vector co-administration did not affect the immune responses against FSP encoded by a single vector, thus excluding immune interference in presence of the vaccine mixture of FSPs (FIG. 10). Finally, quality of T cell responses was assessed by intracellular staining (ICS) by using two peptide pools (pool1 and pool3) and showing the induction of FSP-specific CD4 and CD8 IFN gamma+ T cells (FIG. 11).

As explained in Example 4, it was verified whether immunogenic responses against FSPs in Nous-209 could also be measured in vivo. HLA-A02+ transgenic mice were immunized with a subset (30 FSPs) of Nous-209 FSPs or with a DMSO negative control. Vaccine-induced immune responses were evaluated by cytofluorimetry (FACS) using nonamers selected from the 30 FSPs based on binding prediction to HLA-A02. FIG. 11 shows a representative CD8 T cell response in 5 animals to a HLA-A02 nonamer present in FSP SEQ ID NO: 123, as measured by intracellular staining (ICS) for interferon γ (IFN-γ) (panel A). FACS plot of gating strategy for IFN-γ+ CD8 T cells from one of those mice are depicted in panel B, showing a significant percentage (5.6%) of FSP-reactive T cells.

Taken together, these results demonstrate that
i) The constructs are highly immunogenic and induce a CD4 and CD8 immune response. ii) The immune response is directed against 16 different peptides pools and therefore recognizes at least 16 different epitopes (one for each pool). It is shown that, even in inbred mice (mice practically genetically identical), the rule of at least one epitope in 400 aa is confirmed, because having 16 epitopes over 6000 aa of vaccine corresponds, on average, to at least one immunogenic epitope in 375 aa.
iii) There is no apparent interference effect, in particular no suppression between the individual vectors since comparable immune responses against vector 1 encoded antigens were measured, whether vector 1 was used alone or combined with the other three vectors. Similarly, comparable immune responses against vector 2 encoded antigens were measured, whether vector 2 was used alone ore combined with the other three.

SEQUENCE LISTING (1220 sequences)

SEQ ID NO: 1 - protein, 154 aa, Artificial Sequence
  modified Homo sapiens FSP
VGAGTGGGPACVPVAEASTGAWTAEGAAGTRCRASRAPCRQLPASSPTKCEICVKRRRRRKRSSQSRSPVPKKRERMMLPVRARTARSALPQGRAPLEGMLLPRALPSLLSRMPARRESRFWLALQALGLRPPHLPSCHPLPQLLGPPPPHQAP

SEQ ID NO: 2 - protein, 74 aa, Artificial Sequence
  modified Homo sapiens FSP
TKCEICVKNTAILAITLITPQDPHLDPVCHPHRRPGWKGHHRVVFSHHPSGSTKSHWQQRERGGGRREKKGCRE

SEQ ID NO: 3 - protein, 8 aa, Homo sapiens
GGKKRSKF

SEQ ID NO: 4 - protein, 8 aa, Homo sapiens
VHKKRGLF

SEQ ID NO: 5 - protein, 40 aa, Homo sapiens
VPPSPPLALGPRMQLCTQLARFFPITPPVWHILGPQRHTP

SEQ ID NO: 6 - protein, 44 aa, Homo sapiens
QPSLPGPCASLLSTLSQPPPQAPSQVWTAATLRCPAVPAAACPP

SEQ ID NO: 7 - protein, 31 aa, Homo sapiens
RATFLLALWECSLPQARLCLIVSRTLLLVQS

SEQ ID NO: 8 - protein, 21 aa, Homo sapiens
RNSRRATPTSKGSLRRKYLRV

SEQ ID NO: 9 - protein, 8 aa, Homo sapiens
VLKKNRKQ

SEQ ID NO: 10 - protein, 10 aa, Homo sapiens
TAFFLLDIIL

SEQ ID NO: 11 - protein, 12 aa, Homo sapiens
RQINRRKLQRKK

SEQ ID NO: 12 - protein, 32 aa, Homo sapiens
RGPRRKVLMVLWLPANQSLQKSQVFQWVLRTE

SEQ ID NO: 13 - protein, 11 aa, Homo sapiens
CRCRREYRVTM

SEQ ID NO: 14 - protein, 38 aa, Homo sapiens
GEKNDLQLFVMSDTTYKIYWTVILLNPCGNLHLKTTSL

SEQ ID NO: 15 - protein, 25 aa, Homo sapiens
RNKKTKLWFSLINIHHRKNPLLPMR

SEQ ID NO: 16 - protein, 26 aa, Homo sapiens
TTTTSSPRRSPALRARGGTTIGEVTS

SEQ ID NO: 17 - protein, 27 aa, Homo sapiens
NLHLCYYHSQSNRNKSRQMESLGMKLQ

SEQ ID NO: 18 - protein, 11 aa, Homo sapiens
MPSSWSSSGRT

SEQ ID NO: 19 - protein, 10 aa, Homo sapiens
PGTSLQCYLN

SEQ ID NO: 20 - protein, 27 aa, Homo sapiens
KGKNSPCCQKKLRVQNQGHLLMILLHN

SEQ ID NO: 21 - protein, 17 aa, Homo sapiens
NILNSLPSSMEIAVLQE

SEQ ID NO: 22 - protein, 11 aa, Homo sapiens
NMGGNRSICLT

SEQ ID NO: 23 - protein, 17 aa, Homo sapiens
ELSLEPWIPYLHQQKTQ

SEQ ID NO: 24 - protein, 73 aa, Homo sapiens
FLIHLRKVDTHHLQVVTKTVTATTADGQRMRRLKCKACRLRWARPEPAAQAPPKSHFPPHPSGPSRTSSLQLR

SEQ ID NO: 25 - protein, 11 aa, Homo sapiens
EWGGQAHRQRN

SEQ ID NO: 26 - protein, 10 aa, Homo sapiens
IVFFLAPYFP

SEQ ID NO: 27 - protein, 9 aa, Homo sapiens
PKFFLTFSQ

SEQ ID NO: 28 - protein, 77 aa, Homo sapiens
ARQPSRPTGRTPTTRLMAPVGSVMSCSLLTQPSPASACTMPPLLHPQWAPHSAGLSPGACRPACTCISMTTISRATW

SEQ ID NO: 29 - protein, 11 aa, Homo sapiens
TAKKSPTSFCC

SEQ ID NO: 30 - protein, 38 aa, Artificial Sequence
  modified Homo sapiens FSP
RKRKREKRSQKSRQNHLQLKSCRRKISNWSKLRSPWIF

SEQ ID NO: 31 - protein, 18 aa, Homo sapiens
RHPSWPWTRCLRMRPPRS

SEQ ID NO: 32 - protein, 16 aa, Homo sapiens
SNGMEACGTHPTPRLS

SEQ ID NO: 33 - protein, 30 aa, Homo sapiens
RASVSFWTLLPTTGVRTRGSPLRLTLWPPR

SEQ ID NO: 34 - protein, 53 aa, Homo sapiens
ALRSMPKSRNQVLFRRNLTPSQLRTLAPPYMLLPQSLSQSLSRKQIPSQSMLV

SEQ ID NO: 35 - protein, 34 aa, Artificial Sequence
  modified Homo sapiens FSP
LQAHPQVPALAPQAWWPARRGPLTSAPSAQQSLT

SEQ ID NO: 36 - protein, 27 aa, Homo sapiens
CTNLSVPMMLTILIWKRVFILLLSDKK

SEQ ID NO: 37 - protein, 9 aa, Homo sapiens
PLFFHGDLC

SEQ ID NO: 38 - protein, 9 aa, Homo sapiens
VSKKRLPKL

SEQ ID NO: 39 - protein, 11 aa, Homo sapiens
RRKKREDHCGL

SEQ ID NO: 40 - protein, 17 aa, Artificial Sequence
  modified Homo sapiens FSP
CLRVRCGGWLCGWTPRG

SEQ ID NO: 41 - protein, 16 aa, Homo sapiens
RESTLGNFWMKLLQLP

SEQ ID NO: 42 - protein, 10 aa, Homo sapiens
ASSPGHPLGP

SEQ ID NO: 43 - protein, 56 aa, Homo sapiens
QWSSVTSLEWTAQERGCSSWLMKQTWMKSWSLRDPSYRSILEYVSTRVLWMPTSTV

SEQ ID NO: 44 - protein, 31 aa, Homo sapiens
NIRKLIWTKQRSFLSLFPKLRATEQMTNVGC

SEQ ID NO: 45 - protein, 11 aa, Homo sapiens
VVINLKRLQKF

SEQ ID NO: 46 - protein, 39 aa, Homo sapiens
NGIWEVMPRTLEGCISVKDHRTSQNHSKCITECVRTALN

SEQ ID NO: 47 - protein, 13 aa, Homo sapiens
RRKWQIRHVLKNL

SEQ ID NO: 48 - protein, 18 aa, Homo sapiens
HQMKCLTAVDCLQAFWDM

SEQ ID NO: 49 - protein, 11 aa, Homo sapiens
KNKKRRKLRPK

SEQ ID NO: 50 - protein, 28 aa, Homo sapiens
TGMEILLWILLKMEIQIFKICLGEMQLC

SEQ ID NO: 51 - protein, 43 aa, Homo sapiens
QRKVVKNPSQPVPLRNDGITNGNDSTRSCSISLKKSLEKMPLM

SEQ ID NO: 52 - protein, 20 aa, Homo sapiens
REKIINPTISCPFQSPTKRL

SEQ ID NO: 53 - protein, 62 aa, Homo sapiens
REWEKRKQILGGGGKYKEYFLKRILIRKAMTVLAGDKKGLGRFMRCVQSETKAVSLQLPLGR

SEQ ID NO: 54 - protein, 8 aa, Homo sapiens
NAKKMPFQ

SEQ ID NO: 55 - protein, 8 aa, Homo sapiens
ADKKNVRS

SEQ ID NO: 56 - protein, 12 aa, Homo sapiens
QEKKSRKLMSSC

SEQ ID NO: 57 - protein, 8 aa, Homo sapiens
IQKKKQKS

SEQ ID NO: 58 - protein, 43 aa, Homo sapiens
TEIQLTMNDSKHKLESPALKQVSPASPPTQQPQTPQDSRQVLA

SEQ ID NO: 59 - protein, 46 aa, Homo sapiens
HWNSAYLGRTLLVTCILYHRWIVTSMCQSQRWLTSTTSRSSALMWT

SEQ ID NO: 60 - protein, 13 aa, Homo sapiens
RKSGVMKCWDLCP

SEQ ID NO: 61 - protein, 13 aa, Homo sapiens
CQKKVPSASPWGL

SEQ ID NO: 62 - protein, 10 aa, Homo sapiens
RLPCKVTESS

SEQ ID NO: 63 - protein, 15 aa, Homo sapiens
NQQLKWTPHILKSAS

SEQ ID NO: 64 - protein, 22 aa, Homo sapiens
NMEHRLTMDSALSLTKREGPET

SEQ ID NO: 65 - protein, 22 aa, Homo sapiens
PACTSKAWTPRKLVGRAVRRKG

SEQ ID NO: 66 - protein, 12 aa, Homo sapiens
FKKKKPLTFSPS

SEQ ID NO: 67 - protein, 8 aa, Homo sapiens
QRPPLQPV

SEQ ID NO: 68 - protein, 8 aa, Homo sapiens
LKKKYLVQ

SEQ ID NO: 69 - protein, 50 aa, Homo sapiens
TSRILNLQVLKKILRSFMKLYHSLVMCLRLRTKLEKALSALFIWPQHSYK

SEQ ID NO: 70 - protein, 40 aa, Homo sapiens
STRREMPSQATPSPPGPWRAALGKEVKRSQSKLRLRNTSP

SEQ ID NO: 71 - protein, 16 aa, Homo sapiens
NSRKKLLEDMKQNGFT

SEQ ID NO: 72 - protein, 10 aa, Homo sapiens
CKKKLLLKLL

SEQ ID NO: 73 - protein, 11 aa, Homo sapiens
DKKKKSTEKTK

SEQ ID NO: 74 - protein, 32 aa, Homo sapiens
TPLSISRPTSRARQSCCLPGLTHPAHQPLGSM

SEQ ID NO: 75 - protein, 11 aa, Homo sapiens
RYKKRGVIAWR

SEQ ID NO: 76 - protein, 8 aa, Homo sapiens
HLKKTSAK

SEQ ID NO: 77 - protein, 15 aa, Homo sapiens
GQAFGSFSADFSAPQ

SEQ ID NO: 78 - protein, 31 aa, Homo sapiens
GQAFGSLCQLVSADFSAPQVTRLRSLNHLLI

SEQ ID NO: 79 - protein, 19 aa, Homo sapiens
GHREGSESDNLGLLYSFPP

SEQ ID NO: 80 - protein, 8 aa, Homo sapiens
SEKKRKLP

SEQ ID NO: 81 - protein, 62 aa, Homo sapiens
TYMEMHYGHQAPQVAMLPKLLCRQMLPTLSTLQQRHPQGPCPPPVTPLRVQSVLLLGVPQTA

SEQ ID NO: 82 - protein, 62 aa, Homo sapiens
MCSSLALPTGLTSLILPSSDLAVLISSSTSHFLMRSPVLPSSRLTCASPQLPRMWTWSSWLK

SEQ ID NO: 83 - protein, 14 aa, Homo sapiens
WLKNWKRFKLKKKY

SEQ ID NO: 84 - protein, 11 aa, Homo sapiens
RRNLQRNLKVL

SEQ ID NO: 85 - protein, 155 aa, Artificial Sequence
  modified Homo sapiens FSP
YPRLKTFGVPLGSILCLAGSLSTMMIISTTRQECGRRASVPCRPMIGSARPGPWRTSAMPSAMGVALPTSCESGRSPPATGGRMPGSQSIMMSWMPPLAPCAACPCSPAPTLCPAHPARAPTAVPAFTPLSAHPVPVLSGCHLAVRTSMLTLLPM

SEQ ID NO: 86 - protein, 15 aa, Homo sapiens
VLFKADQSESSLSSG

SEQ ID NO: 87 - protein, 13 aa, Homo sapiens
RRSKIEASPIGSI

SEQ ID NO: 88 - protein, 10 aa, Homo sapiens
YLFFLTVCGF

SEQ ID NO: 89 - protein, 19 aa, Homo sapiens
QAPLRLWSWCGTSQTYFGS

SEQ ID NO: 90 - protein, 50 aa, Artificial Sequence
  modified Homo sapiens FSP
GKGLTHPVPLKRTLQNKRNKNIKRVNQKKGNIKRKSILLHLIVLNSPESN

SEQ ID NO: 91 - protein, 13 aa, Homo sapiens
TPPPLILWPQAAP

SEQ ID NO: 92 - protein, 10 aa, Homo sapiens
MSRTPPRRVC

SEQ ID NO: 93 - protein, 8 aa, Homo sapiens
LAKKTLTN

SEQ ID NO: 94 - protein, 32 aa, Homo sapiens
PLENTQIPRTSPLWKITMVLTYPNCVVHVLMF

SEQ ID NO: 95 - protein, 30 aa, Homo sapiens
VSVITMKLWEKHFKGLNWNLVVWILNLKMM

SEQ ID NO: 96 - protein, 23 aa, Homo sapiens
IICIKNMFLQRKGFLNLSHVEKF

SEQ ID NO: 97 - protein, 12 aa, Homo sapiens
LKKKPRDICRIS

SEQ ID NO: 98 - protein, 12 aa, Homo sapiens
RLRIPSLRKYRQ

SEQ ID NO: 99 - protein, 30 aa, Homo sapiens
RGASSSTSRDSRSFFTSAHPSRPCRMRLYQ

SEQ ID NO: 100 - protein, 24 aa, Homo sapiens
NPRRKTWKMRKKYAQKPSQKNHLY

SEQ ID NO: 101 - protein, 11 aa, Homo sapiens
IAKKRIKLRRN

SEQ ID NO: 102 - protein, 10 aa, Homo sapiens
FDKKGFVILS

SEQ ID NO: 103 - protein, 12 aa, Homo sapiens
GSPPLHLCQPLR

SEQ ID NO: 104 - protein, 9 aa, Homo sapiens
ELKKNLLLP

SEQ ID NO: 105 - protein, 77 aa, Homo sapiens
RHPHRSPPTSCPPLLEAFPLPRASLRATVPRHSSVLATGLHLHRQISLPLRGFLLHQPLPGQHLWLSHRLRLRLPRT

SEQ ID NO: 106 - protein, 13 aa, Homo sapiens
AAPPHRLLGPSRW

SEQ ID NO: 107 - protein, 14 aa, Homo sapiens
LPLTFSTLLWDSRH

SEQ ID NO: 108 - protein, 25 aa, Homo sapiens
ITHPFASQPLGQEMPNNTQIRLLKP

SEQ ID NO: 109 - protein, 20 aa, Homo sapiens
RAFIHTPRSPGCSVYANMCW

SEQ ID NO: 110 - protein, 18 aa, Homo sapiens
MTLKALVKTWTQFRNYPR

SEQ ID NO: 111 - protein, 19 aa, Homo sapiens
AFWKPPSQGISSCLMTGCW

SEQ ID NO: 112 - protein, 10 aa, Homo sapiens
FEKKRPEWLS

SEQ ID NO: 113 - protein, 9 aa, Homo sapiens
MAKKSQQPL

SEQ ID NO: 114 - protein, 9 aa, Homo sapiens
EAKKSMKRS

SEQ ID NO: 115 - protein, 125 aa, Homo sapiens
RKRMKTGAIQEKGAIQEKGAMTKRICVVNFEACREMESLSAPEKITLFEAHMARCTSINVLCVRASLIEKLMKEKRKMKRNQVASPQIMQRLFIKGYQNNHFTFHLQNFAFFSSFGNNKYINILT

SEQ ID NO: 116 - protein, 17 aa, Homo sapiens
ASPQIMQRMSAVNFETI

SEQ ID NO: 117 - protein, 35 aa, Homo sapiens
ASPQIMQRTSADRFRMKRRMQNLDNLGVPWPLLPG

SEQ ID NO: 118 - protein, 45 aa, Homo sapiens
GDCPRTMAGPSASLHPASGRASRKTWQRRLRACRAGGPAGWARQA

SEQ ID NO: 119 - protein, 12 aa, Homo sapiens
GEKLKHCFKAWG

SEQ ID NO: 120 - protein, 10 aa, Homo sapiens
MLNQKCLAPF

SEQ ID NO: 121 - protein, 10 aa, Homo sapiens
SLILSFQRVK

SEQ ID NO: 122 - protein, 8 aa, Homo sapiens
GAKKITFL

SEQ ID NO: 123 - protein, 43 aa, Homo sapiens
WWCTRGGGKRKKKMCKVSGGCTACVERCPWKGICWKWPVTVAA

SEQ ID NO: 124 - protein, 16 aa, Homo sapiens
RTLESAGLFPWLHTQC

SEQ ID NO: 125 - protein, 12 aa, Homo sapiens
SQKKDPAGKLKK

SEQ ID NO: 126 - protein, 12 aa, Homo sapiens
PIPPHLRHPLLL

SEQ ID NO: 127 - protein, 30 aa, Homo sapiens
VPMSLACSITVSFVGQISTLVLDVSSISHW

SEQ ID NO: 128 - protein, 8 aa, Homo sapiens
DSKKMTQK

SEQ ID NO: 129 - protein, 64 aa, Homo sapiens
RSLLYSRMCLVQIPTHTWEPDYFVSLPMMFSWATQSFPVGAVFLTRPAIPCCSCTSHSNPWSQS

SEQ ID NO: 130 - protein, 29 aa, Homo sapiens
RRRNSRKQSQVQLAIQVLLVDKHKYFLFG

SEQ ID NO: 131 - protein, 11 aa, Homo sapiens
RLDFHPRSSSG

SEQ ID NO: 132 - protein, 10 aa, Homo sapiens
ILAMTLTLNG

SEQ ID NO: 133 - protein, 10 aa, Homo sapiens
QRPPRSILSL

SEQ ID NO: 134 - protein, 11 aa, Homo sapiens
LEKKATWMRRT

SEQ ID NO: 135 - protein, 44 aa, Homo sapiens
GAAAASCQSPPSPRETTPSSDATRRTRPIAAQSKKTMTAAGLTP

SEQ ID NO: 136 - protein, 28 aa, Homo sapiens
IEALTALFTCRTASISVNISTLMSILEA

SEQ ID NO: 137 - protein, 30 aa, Homo sapiens
AFSGRILHQPEMAAMRLMPKFLNSTNSWWT

SEQ ID NO: 138 - protein, 17 aa, Homo sapiens
ILFHVRNIVYGIQVMLC

SEQ ID NO: 139 - protein, 25 aa, Homo sapiens
QNTRSTNLEKNPSLKKQSQRRGKLS

SEQ ID NO: 140 - protein, 30 aa, Homo sapiens
RPSPCLSWSSRIVAPGHALSCRTRRRWSSK

SEQ ID NO: 141 - protein, 10 aa, Homo sapiens
NKVRQNFKRN

SEQ ID NO: 142 - protein, 13 aa, Homo sapiens
IYPPSTCSLPCRG

SEQ ID NO: 143 - protein, 12 aa, Homo sapiens
VDPPGSVWILPC

SEQ ID NO: 144 - protein, 12 aa, Homo sapiens
IIKKMKKRIMVH

SEQ ID NO: 145 - protein, 9 aa, Homo sapiens
KGKKRRKEI

SEQ ID NO: 146 - protein, 11 aa, Homo sapiens
LANGLWFNLIF

SEQ ID NO: 147 - protein, 8 aa, Homo sapiens
RGPPLHTR

SEQ ID NO: 148 - protein, 170 aa, Artificial Sequence
  modified Homo sapiens FSP
NEGNNHWPRVEMPTGWLLVGYNTRNTAQNPRLQQHLKHWQQCTRARWCQEPCQTLTFFHFFFFFKTVSLCCPGWSKGQPPPPGLKPSSLASQVARTTGVYQHVWLICFVFFVCVETGFCHVAQVGLERLVSLSGITDVNHWAQPKPSPSKGTGMNRPIGLRVGKGVWARL

SEQ ID NO: 149 - protein, 78 aa, Artificial Sequence
  modified Homo sapiens FSP
RRMTRRTMTTTKMMMMRRTKRRRRKRRRMTMMTRRTLLTKKTCLTPRTSAATKALPRQTISQRRPIQTPPGTSLAIWG

SEQ ID NO: 150 - protein, 40 aa, Homo sapiens
RARNRNMKKTMSHLIAHQALKMSGLRLFHPRLLTRKKPGK

SEQ ID NO: 151 - protein, 15 aa, Artificial Sequence
  modified Homo sapiens FSP
RRARPTSCSTCRMWW

SEQ ID NO: 152 - protein, 25 aa, Homo sapiens
QVSVYSGNLLSFSRRGMKSSVRLKN

SEQ ID NO: 153 - protein, 27 aa, Homo sapiens
QVVLRLGNLPPFFRGSEVPFPRPCRTK

SEQ ID NO: 154 - protein, 30 aa, Homo sapiens
WLPMRSLGEPWRAGFQWGESPWQVMASLTG

SEQ ID NO: 155 - protein, 10 aa, Homo sapiens
EEKKNGRISS

SEQ ID NO: 156 - protein, 13 aa, Homo sapiens
TMSLSNILMKFRL

SEQ ID NO: 157 - protein, 16 aa, Homo sapiens
RWIFSNQLTVQMLCLP

SEQ ID NO: 158 - protein, 114 aa, Homo sapiens
LLTPDTRWIFSNQLQTVQMLCLPPLKQGERIIWPLGGFQIPNFFWSLGIGHTGAWWHTGRRRREWGGSTVSRSPLWISSMIYLRGMAFASDSSIRTTRVSWCRRCGAKSAAASS

SEQ ID NO: 159 - protein, 13 aa, Homo sapiens
IPSLNAQWMFLRI

SEQ ID NO: 160 - protein, 20 aa, Homo sapiens
SRRNRRYRKIYGELKMSLQA

SEQ ID NO: 161 - protein, 16 aa, Homo sapiens
NRKTRKAAREKHRKTD

SEQ ID NO: 162 - protein, 13 aa, Homo sapiens
FLPSRFPWGPPPL

SEQ ID NO: 163 - protein, 45 aa, Homo sapiens
NSVIVHKIVLVFLKSLSSYNCERRISGIQKRAIEFAVLKLLNMDL

SEQ ID NO: 164 - protein, 61 aa, Homo sapiens
VAPRCPRSAVDISPGPTSPSLASCASVAIGKLALLGASAPCGAAGAREAGRFAVLGTMVMK

SEQ ID NO: 165 - protein, 27 aa, Homo sapiens
SPLWDCSTTTGTHHGCLWEIPSVTLLA

SEQ ID NO: 166 - protein, 26 aa, Homo sapiens
TLAIRFISAPQPSSSTVTAAPSGQYF

SEQ ID NO: 167 - protein, 46 aa, Homo sapiens
LLLAHMYGFSTYGTQKGECVCLQCLSGSSLFILKQPLDLKISKTFM

SEQ ID NO: 168 - protein, 9 aa, Homo sapiens
SLFFSHCLC

SEQ ID NO: 169 - protein, 9 aa, Homo sapiens
LKKKVNACS

SEQ ID NO: 170 - protein, 12 aa, Homo sapiens
NAKKMEDMIWES

SEQ ID NO: 171 - protein, 27 aa, Artificial Sequence
  modified Homo sapiens FSP
GSCGRACSCGRGCGTPRGDWKRHPPRR

SEQ ID NO: 172 - protein, 14 aa, Homo sapiens
MIRKIQKRRRTANR

SEQ ID NO: 173 - protein, 10 aa, Homo sapiens
TYTPHICRHT

SEQ ID NO: 174 - protein, 10 aa, Homo sapiens
MKKKDSTIFI

SEQ ID NO: 175 - protein, 8 aa, Homo sapiens
LCFFYLLY

SEQ ID NO: 176 - protein, 11 aa, Homo sapiens
LTTLSFVLIEE

SEQ ID NO: 177 - protein, 75 aa, Homo sapiens
NLDLQHQRRRKKKKDKVEIRNRSPKANSTECQGEHSREQNLLNLVQLNPHSPHHRKDEEDHQKRHHHHNQKKMSV

SEQ ID NO: 178 - protein, 55 aa, Homo sapiens
ASRAGQFPVWRRTSRGMSLQWKSGNACTPLRCPSRSPATFLTALNGWHRSGLRAQ

SEQ ID NO: 179 - protein, 68 aa, Homo sapiens
PYPISEGLTMTTGRNINSNSLMTNCLFSPIFLCHHAIMHRKMTSPHFRLFSSKIPHPQVPSVVALCKF

SEQ ID NO: 180 - protein, 24 aa, Homo sapiens
LKLAPLQVTTTLKLILVMLEIVTE

SEQ ID NO: 181 - protein, 42 aa, Homo sapiens
CRVNAVEELHSRRMSVRIVKNWVSCCYVRLSAVGLSTWSALD

SEQ ID NO: 182 - protein, 27 aa, Homo sapiens
RLPLRPQRGPRPLHRWLQQTTGCSQRR

SEQ ID NO: 183 - protein, 14 aa, Homo sapiens
RKMQSLNHPSRLTN

SEQ ID NO: 184 - protein, 19 aa, Homo sapiens
SRKKGHTKNRRKAKRKPQI

SEQ ID NO: 185 - protein, 11 aa, Homo sapiens
NKIICKGHRIT

SEQ ID NO: 186 - protein, 9 aa, Homo sapiens
SSFFYTSDR

SEQ ID NO: 187 - protein, 9 aa, Homo sapiens
QKKGHMIFS

SEQ ID NO: 188 - protein, 66 aa, Homo sapiens
MLQKQCCYNLVIKHPLIFRINLRRQGKTKDGVVQSLGFLNQQIILQKEFFICLLMFIKRWKPAATK

SEQ ID NO: 189 - protein, 146 aa, Artificial Sequence
  modified Homo sapiens FSP
HPRTASITLPTTSLKGSRTSCCPRSHPRLPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRR

SEQ ID NO: 190 - protein, 78 aa, Homo sapiens
RTRLTLTGTRSSGTRASPSAVCLCCWTCPSRSFPAASPSGLRAPVGAQAPPEVTLRASCASSASKACAGLWPWGAQVR

SEQ ID NO: 191 - protein, 52 aa, Homo sapiens
CHPAWLSPISACPRLLPYPFHVLALEVTFPPGTAMPQMQLQALAMWEKGWDK

SEQ ID NO: 192 - protein, 44 aa, Homo sapiens
MDLDGMLTVIGQGLVGMTPRDLGTVAGATAQIQRPIQVQTGGRL

SEQ ID NO: 193 - protein, 33 aa, Homo sapiens
SQKSQHHCALRKIEWATKLSLGGKAGPQAQEKA

SEQ ID NO: 194 - protein, 29 aa, Homo sapiens
IRMCALSHPSFYISSTVCFLSKHCMTACT

SEQ ID NO: 195 - protein, 13 aa, Homo sapiens
RCSLMEQIPHLKS

SEQ ID NO: 196 - protein, 19 aa, Homo sapiens
LLKKSSQLRRSWRNVSRIS

SEQ ID NO: 197 - protein, 19 aa, Homo sapiens
SIPHVPKATAAHSVTVKLQ

SEQ ID NO: 198 - protein, 11 aa, Homo sapiens
THPCTMLLPQG

SEQ ID NO: 199 - protein, 16 aa, Homo sapiens
SRSHLDFSPYWMKKVK

SEQ ID NO: 200 - protein, 9 aa, Homo sapiens
WLKKSTKSR

SEQ ID NO: 201 - protein, 8 aa, Homo sapiens
DRVFLVKI

SEQ ID NO: 202 - protein, 11 aa, Homo sapiens
NIEITPQRSKA

SEQ ID NO: 203 - protein, 106 aa, Homo sapiens
GALRATAPATAAPQAQTPHWRAATTSSMSSSPRAEPTSSSSWATCWPRCCSSSCYWSLSSWPPAGAAEATNTRTRSRESQRGRMLTWRSSLWLQGTRCFTGVRTSS

SEQ ID NO: 204 - protein, 86 aa, Artificial Sequence
  modified Homo sapiens FSP
QSSPFLARSWNTMQWNNKKMAMTVIAGAHHCQYKLTYTKVWKMNWKKMMIGSQHLLFSPLDSSPLQLLLHPHGKRCNPCCRLTWMS

SEQ ID NO: 205 - protein, 135 aa, Homo sapiens
CRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIF

SEQ ID NO: 206 - protein, 87 aa, Artificial Sequence
  modified Homo sapiens FSP
HLNRKLHLTRSCLIDLTMMMSQKLWKNQRKRIPLPSPRQHLLPQYPLHPPPPCLLLLHHRHHLAFLEMACSSQHTHSIKIWISFSHE

SEQ ID NO: 207 - protein, 89 aa, Homo sapiens
LILIQHGGIFTFRFWVEKLSWNICKNLSLYLDKFVQRLLYVYIIETNVFVLNLFHVPVNQIFMMAFYLKYTEKAWVMELEWLIQQQCYQ

SEQ ID NO: 208 - protein, 53 aa, Artificial Sequence
  modified Homo sapiens FSP
GPVYYVCNRMNVSSVLKPFLFTVPIEDMRECTLGRNRMNVSSVLKPCLIPVPI

SEQ ID NO: 209 - protein, 43 aa, Homo sapiens
DLPRMLPISSPLHRPQMPFWTCTFPATTWGTWETPSTWGWRTF

SEQ ID NO: 210 - protein, 58 aa, Homo sapiens
VIAILSSMCQEILNRHHRRKEVRKLKQILFQVEETKSGRFWIKHDLVSCLQSYLVMEA

SEQ ID NO: 211 - protein, 9 aa, Homo sapiens
WLGMALIFG

SEQ ID NO: 212 - protein, 87 aa, Homo sapiens
ANMDAQPMMPTPNIIAELPRCTGRRSGSWGVRPWLGMALIPLPGMRQPLSLQGPSSQPRLQRAVAWHSRSMAPTQTCLAPHPKPHWN

SEQ ID NO: 213 - protein, 53 aa, Homo sapiens
TALKYIFVAVRAICVMKSFLIFRRWKSHSPLQIQLHLSHPITTSCSIPWCHLC

SEQ ID NO: 214 - protein, 61 aa, Artificial Sequence
  modified Homo sapiens FSP
HRPASSTGSAAWTWTGTAPCPCSSAEGWTAWPSRPCPSRTASARCWTWSSRGLKGRSRCRT

SEQ ID NO: 215 - protein, 35 aa, Homo sapiens
NDLQLFVMSDTTYKIYWTVILLNPCGNLHLKTTSL

SEQ ID NO: 216 - protein, 33 aa, Homo sapiens
VSWYSHQKKLTVPHSLLFRHKSRRLRLCYMANW

SEQ ID NO: 217 - protein, 12 aa, Homo sapiens
VNLSSPKASLLR

SEQ ID NO: 218 - protein, 22 aa, Homo sapiens
MNSVNLSSPKARDWTVSELLKN

SEQ ID NO: 219 - protein, 20 aa, Artificial Sequence
  modified Homo sapiens FSP
NPDNGGGSFWQEALLVLWTV

SEQ ID NO: 220 - protein, 17 aa, Homo sapiens
QRKPKRANCVIQRRAKM

SEQ ID NO: 221 - protein, 11 aa, Homo sapiens
MQKKWPITYVA

SEQ ID NO: 222 - protein, 11 aa, Homo sapiens
GGGGSWSSPSG

SEQ ID NO: 223 - protein, 16 aa, Homo sapiens
GKDRYCSNIDKHWLNS

SEQ ID NO: 224 - protein, 8 aa, Homo sapiens
RADPQRHT

SEQ ID NO: 225 - protein, 8 aa, Homo sapiens
RAFFGGLL

SEQ ID NO: 226 - protein, 117 aa, Homo sapiens
TSLWSSMPHGVVTANSWLPFGINWERRTRTMRTSSSPRWTRLPTRWRPSKCTASPHSSSFLPVPTGRSLITTGNARWMVLRNSWRAVARMGQGMMTISRTWKKQRSQTWRKTMIRKL

SEQ ID NO: 227 - protein, 117 aa, Homo sapiens
CRTRPRKAASAQSSRSGGEGGSVLVGMERTASTGETVEMRRWWTLVMEWKSSYRAATPCPAPPRPARVPAHASTSLSSHITLKPVTPQERKTQDVGMAVSMDTISIVTMWGEGGGVG

SEQ ID NO: 228 - protein, 57 aa, Homo sapiens
VARVEVAAGPPMREVAEAAAVVMVVRPVATLSPGEARAPLESVRQIYSEHNYCRLIL

SEQ ID NO: 229 - protein, 38 aa, Homo sapiens
RLPGLTCKVRRTLHQLKLCQRVMILSVVFQILMTCQWP

SEQ ID NO: 230 - protein, 26 aa, Homo sapiens
CLESGTDHILTEILSISCKKMNQMEL

SEQ ID NO: 231 - protein, 27 aa, Homo sapiens
RGGAPLPSWSPPCQSLRQAVTSSRTSG

SEQ ID NO: 232 - protein, 13 aa, Homo sapiens
IASTFYLDGNVSS

SEQ ID NO: 233 - protein, 11 aa, Homo sapiens
ECCSSWLRRIE

SEQ ID NO: 234 - protein, 24 aa, Homo sapiens
MECSKLKLFNLFWTWQREPVMQPQ

SEQ ID NO: 235 - protein, 13 aa, Homo sapiens
LQKKNSRKRKQKG

SEQ ID NO: 236 - protein, 12 aa, Homo sapiens
LVVCLSRRMKRC

SEQ ID NO: 237 - protein, 20 aa, Homo sapiens
VDSSSYHPFKINQNIRFQKF

SEQ ID NO: 238 - protein, 12 aa, Homo sapiens
RKRRRRKRKRAN

SEQ ID NO: 239 - protein, 20 aa, Homo sapiens
PYKFSEYRRAFSWSADITGT

SEQ ID NO: 240 - protein, 10 aa, Homo sapiens
ILFFYMAYLW

SEQ ID NO: 241 - protein, 14 aa, Homo sapiens
NGLPETEKMPQLMP

SEQ ID NO: 242 - protein, 12 aa, Homo sapiens
YYQKTWRVILPD

SEQ ID NO: 243 - protein, 97 aa, Homo sapiens
STWFHVTSGTSLSCALPSVLARWNLPMCSGPGNTSKSWRPTCCEQRGSRSEASCRNQKLKRDISENWNKKQINIILPSWNSAVCGFPCLSPKLSRGL

SEQ ID NO: 244 - protein, 58 aa, Homo sapiens
SAAWRSCIALWCASSVTERTRCAGRWLWYCWPTWLRGTAWQLVPLQCRRAVSATSWAS

SEQ ID NO: 245 - protein, 60 aa, Homo sapiens
AVTRASAPRATAAAGAWRGRRPPTARSSATTRGPPSSTSRAVGRPPCWRGPGSTTHTSRP

SEQ ID NO: 246 - protein, 25 aa, Homo sapiens
TIKISQIQNQSVNKNFHIHLKRTYQ

SEQ ID NO: 247 - protein, 77 aa, Artificial Sequence
  modified Homo sapiens FSP
AETITQLYGKHYASGWMMLMSKTPRTYRMCTVGMPRSVCGWPSCFPGLAGSSQGPTLRSGSHCPQDCRRNVNREKTE

SEQ ID NO: 248 - protein, 63 aa, Homo sapiens
AALQTGPGSCPPSRAASLLFSIRRWSTISCPRPSATSQTPGRGVPPRAPASPGRRPLKKWPTP

SEQ ID NO: 249 - protein, 67 aa, Homo sapiens
ASPLKRDPQQGQFIPSQPPTLPWTLRKQPQGPSCSRGSQRAVRGTSPSQGILGSTGCSLGSRLHSWC

SEQ ID NO: 250 - protein, 58 aa, Homo sapiens
NGKLSPRTAVGAARNIRSSSFRSPHTSPFFGPTSGCLGFTQEPPLPQFPRTCHFMFLF

SEQ ID NO: 251 - protein, 15 aa, Homo sapiens
MKALISQEMFSQALL

SEQ ID NO: 252 - protein, 33 aa, Artificial Sequence
  modified Homo sapiens FSP
DTTFQRAPLKFKLALKRVCRKSVLGSGGQRTSW

SEQ ID NO: 253 - protein, 28 aa, Homo sapiens
SFLVLRFMSQIILSEFWMCCGLVPTSSP

SEQ ID NO: 254 - protein, 39 aa, Homo sapiens
TRGTGWPLAGQQPGSCPSQHQGLPGRLPPPRPLQRVRHT

SEQ ID NO: 255 - protein, 44 aa, Homo sapiens
CRRLVSTLNFSAHLLMWTPCTVTWPICTLSSSKTHSTSMHMQQS

SEQ ID NO: 256 - protein, 25 aa, Homo sapiens
LERFETLKIKSSKNICFLHVSVCPS

SEQ ID NO: 257 - protein, 16 aa, Artificial Sequence
  modified Homo sapiens FSP
TLMMSNGCWGWQQSWE

SEQ ID NO: 258 - protein, 45 aa, Homo sapiens
SLLKRNMKSSWMFAKIFNQFSVTSAWKNSWIQLFGLRSDWLIRAV

SEQ ID NO: 259 - protein, 27 aa, Homo sapiens
AGSTGASRPLRTRRTRSQCRRSWSPAR

SEQ ID NO: 260 - protein, 27 aa, Artificial Sequence
  modified Homo sapiens FSP
HPAARSSSCCPAPMSLSWGTALMTSPR

SEQ ID NO: 261 - protein, 16 aa, Homo sapiens
RSQNHQKSPQALAMPW

SEQ ID NO: 262 - protein, 30 aa, Homo sapiens
RSQNHQKRKVLGTILVHNHIIDYAWVICHL

SEQ ID NO: 263 - protein, 25 aa, Homo sapiens
ISFGYPRWTLKALVYSQNGVLIWLM

SEQ ID NO: 264 - protein, 8 aa, Homo sapiens
KEKKGGSE

SEQ ID NO: 265 - protein, 12 aa, Homo sapiens
ELLHPSQRLLVP

SEQ ID NO: 266 - protein, 17 aa, Homo sapiens
VIFFSKPKRIKNLSLKT

SEQ ID NO: 267 - protein, 26 aa, Homo sapiens
KSARTALNSELDVQNAVHENQKERVF

SEQ ID NO: 268 - protein, 19 aa, Artificial Sequence
  modified Homo sapiens FSP
IILDTAKLLTSPQSLLPIR

SEQ ID NO: 269 - protein, 11 aa, Homo sapiens
RILLGTFLAIP

SEQ ID NO: 270 - protein, 24 aa, Homo sapiens
GCCRLLTEMGKRKRKRRSHWMKAQ

SEQ ID NO: 271 - protein, 11 aa, Homo sapiens
LINPDKKIKMI

SEQ ID NO: 272 - protein, 8 aa, Homo sapiens
NKKKVNKN

SEQ ID NO: 273 - protein, 12 aa, Homo sapiens
FIFFLILWSSRQ

SEQ ID NO: 274 - protein, 12 aa, Homo sapiens
MKKENKIKWKLN

SEQ ID NO: 275 - protein, 13 aa, Homo sapiens
KESPGREKGMEKM

SEQ ID NO: 276 - protein, 18 aa, Homo sapiens
LAFSSLLWPSHLDMSMLQ

SEQ ID NO: 277 - protein, 17 aa, Homo sapiens
KPNKNTQITFSLMSFTL

SEQ ID NO: 278 - protein, 12 aa, Homo sapiens
RFFPSILIKSYI

SEQ ID NO: 279 - protein, 12 aa, Homo sapiens
GSPPGGPRPCWT

SEQ ID NO: 280 - protein, 13 aa, Homo sapiens
SIGYLTGFCSPNA

SEQ ID NO: 281 - protein, 13 aa, Homo sapiens
EEPPSCRPTAHIP

SEQ ID NO: 282 - protein, 13 aa, Homo sapiens
EQKTEWEWKLQIE

SEQ ID NO: 283 - protein, 12 aa, Homo sapiens
KVAFLCEKEQIV

SEQ ID NO: 284 - protein, 8 aa, Homo sapiens
QLKKAVKV

SEQ ID NO: 285 - protein, 12 aa, Homo sapiens
LQRMSSDKRNTG

SEQ ID NO: 286 - protein, 9 aa, Homo sapiens
INKKIQATK

SEQ ID NO: 287 - protein, 93 aa, Homo sapiens
TSSPRTMSWLCCLGQIMASAVEASQPPTWPSMPRRTPVGPVSSPARQEGVRVCSGCVTCGETAPMAAMTTAAAPCSHPQSWPVSLSRWRCASV

SEQ ID NO: 288 - protein, 112 aa, Homo sapiens
VGKPLPRSHTAQNIREHTQERDPLSAVNAGNRLVRSHTSMYIEKCTQEKDRIVAENVENPSARSHASINIGELTQERSPMGAMNVGKLSTRSQTSADIRKFMLGRMPTGMKT

SEQ ID NO: 289 - protein, 59 aa, Artificial Sequence
  modified Homo sapiens FSP
CRASLRTDCLLAVVIQFQISTYQAQLRISLRKKKTKQDILTHIIECLKKMKTSTSLGMI

SEQ ID NO: 290 - protein, 94 aa, Homo sapiens
VAPCPWSWGSLRMLVQPEMRAPYGSVLTHCQRLMTHYCAMLGQLSAEAKLRGRRGGGAAPQPVPASNRVAAAVSQEDAGLVEEPMEDVVEDGPG

SEQ ID NO: 291 - protein, 82 aa, Homo sapiens
NTHLQLTHCFLEIKPYSTKKMKMACGKRSLLQEVKKHELPKKAPSWPDRPLVGLARIQIWILHLLGLRPPSLLSVFQMTFIK

SEQ ID NO: 292 - protein, 88 aa, Homo sapiens
GGFRQWWCTCRMSGPSCLLWRSGRPCASRKLQRQLPQPRRHKGKRSLLNRHLMPWSKQQTLLDGTQKLQRPPHSRKRTLISQRPLHPP

SEQ ID NO: 293 - protein, 62 aa, Homo sapiens
LAGLLCPALHLVKPRVLHQNLDPTSSSFSKWCRPWLEQMLHSCRIQKSDFSNNWNSSTQWGS

SEQ ID NO: 294 - protein, 127 aa, Artificial Sequence
  modified Homo sapiens FSP
NVHRQPVQIIKNMETTVTYRKKQIQSQSSTSILSALRVSPVRNSPCSMCCVIIPPGSSHACVQKVTSSLGIRAQGTRRSSNKPLRGDPGVIVPCLCLEEPRKGLWERSPGHPRGSQSALGTASEGWS

SEQ ID NO: 295 - protein, 16 aa, Artificial Sequence
  modified Homo sapiens FSP
NVHRQPVQQIQSQSST

SEQ ID NO: 296 - protein, 14 aa, Artificial Sequence
  modified Homo sapiens FSP
VHRQPVQIQSQSST

SEQ ID NO: 297 - protein, 30 aa, Homo sapiens
SRPGWKRTQQRPPWRTSRGQAQDTSGHRGS

SEQ ID NO: 298 - protein, 53 aa, Homo sapiens
AAALGLRILPPPLTSPSRSTTAPVGSQCVPSWTARRWSTTASGWRRWTTARPP

SEQ ID NO: 299 - protein, 37 aa, Homo sapiens
LSAIRKMTYFTSWILDSDSTHYIPSCNRKSCYKRMWS

SEQ ID NO: 300 - protein, 54 aa, Homo sapiens
WETLSTWRPSERWSCRSPASLPRMWCWCHQASMPWRATPPLLGATTSPPDASGT

SEQ ID NO: 301 - protein, 42 aa, Artificial Sequence
  modified Homo sapiens FSP
YKGRKERKTSVQGITTVILKRRTSLRRESFMKNFLAVTITGS

SEQ ID NO: 302 - protein, 67 aa, Artificial Sequence
  modified Homo sapiens FSP
RPPMTTWPRMRMTLRWARGSLPGPARARPTTPLLPWRTTCSSRPRVGASRPAPHRPQRSSRRYSRSA

SEQ ID NO: 303 - protein, 71 aa, Artificial Sequence
  modified Homo sapiens FSP
RSTGLTGEQTHWLRPTSGPATMSPWYRGPTPSPLTCRCTTPPASPWLPIPVRPMGARAPAPTCVSSTTTGS

SEQ ID NO: 304 - protein, 40 aa, Artificial Sequence
  modified Homo sapiens FSP
RSLPAGPSSRRRAPPRSGRGSLRKWRPGASRRWRMSTWPS

SEQ ID NO: 305 - protein, 43 aa, Homo sapiens
VSTSWGPTAGAARARTCSPCSPTTPSPASGSTSRRTRPNRVLT

SEQ ID NO: 306 - protein, 45 aa, Artificial Sequence
  modified Homo sapiens FSP
TWPAACWATWTSPGAAVPVALRPSASWSRCTCSSSATMWRSTTPR

SEQ ID NO: 307 - protein, 32 aa, Homo sapiens
RRSRAECGSTRSLTARRETPTATMCAAPRVSP

SEQ ID NO: 308 - protein, 57 aa, Homo sapiens
MVKRKNPKRRKLQELLKRRKLRKNSNLSHMMIRFFWMEMRCMYGSMTQFTLKHLSWD

SEQ ID NO: 309 - protein, 35 aa, Artificial Sequence
  modified Homo sapiens FSP
REPLVLSVGNLIGLPIMPSRCENSSLGGMLEMSMH

SEQ ID NO: 310 - protein, 28 aa, Homo sapiens
LPGGIASRFPASWPRTPAACHPSLRTGT

SEQ ID NO: 311 - protein, 66 aa, Homo sapiens
GMTSTCPSAMTWATSSPCSATERATSAGVWTKMAERCRAPAPSQAPPLRVYPPSLHPWSGPRPGQM

SEQ ID NO: 312 - protein, 38 aa, Homo sapiens
GGRMLLEMMKRLVRKNLKKTMMILKTSLKMSFQKMRKR

SEQ ID NO: 313 - protein, 47 aa, Artificial Sequence
  modified Homo sapiens FSP
SHIWPKGFEAQRAQEHRAQLVCSALLPEGIRCRPGAPAAVSPPRGSQ

SEQ ID NO: 314 - protein, 50 aa, Artificial Sequence
  modified Homo sapiens FSP
QTSHWCPTQPRRVASRVWPSTTTLSCPPRSSTSCSTAATAPSPCTPRAAE

SEQ ID NO: 315 - protein, 22 aa, Homo sapiens
SNCQLVTAVPNWNLFSTVLLHL

SEQ ID NO: 316 - protein, 36 aa, Homo sapiens
NDGGGSRSWHLPSHPMQQTPTTARPSTQTSWPSWPS

SEQ ID NO: 317 - protein, 30 aa, Homo sapiens
LILEKSPINVKKCKGFNHYSFCQKHEQSHT

SEQ ID NO: 318 - protein, 26 aa, Homo sapiens
NPPVKESQVARRKCLKEMARRKKTEE

SEQ ID NO: 319 - protein, 17 aa, Homo sapiens
LAMTDDQRMVKNKQLLM

SEQ ID NO: 320 - protein, 21 aa, Homo sapiens
MLTQTDSAWDLEIAEVLFHIQ

SEQ ID NO: 321 - protein, 34 aa, Homo sapiens
AFRDRNTRILGRVSAPEASHDTVTFRTARKGEKF

SEQ ID NO: 322 - protein, 54 aa, Homo sapiens
GKLFRRSKFEAKPTSGPWQPGRNITTKLIQRPLRSSLGSRKTPPSLPFLGEEEL

SEQ ID NO: 323 - protein, 26 aa, Homo sapiens
SSHMHNTSPCQMMSHLNHVQFVLYKL

SEQ ID NO: 324 - protein, 32 aa, Homo sapiens
CYLAGSKMTSLTSGWNGKRQSCSQLCLLPCTI

SEQ ID NO: 325 - protein, 73 aa, Homo sapiens
RRGTSQRAQSGPLSFVLHFLAKDPHPMFLCTPRAHPLARPQGHLLAHPGPSPTWPGPLPLPQTRLDLSAGPTA

SEQ ID NO: 326 - protein, 24 aa, Homo sapiens
SSIHIVEKQLKLRERPTNKKKRKN

SEQ ID NO: 327 - protein, 25 aa, Homo sapiens
LQKKAPQKRIKLLRMLPALYLMACQ

SEQ ID NO: 328 - protein, 40 aa, Artificial Sequence
  modified Homo sapiens FSP
AAQMSWSLPCPPGGAEERMEAPSVGVARRRRRSKGSSMRC

SEQ ID NO: 329 - protein, 24 aa, Homo sapiens
MTPGPGAGPAACSSCAPALCAAAA

SEQ ID NO: 330 - protein, 34 aa, Homo sapiens
TSRGSSLQASSWKMAALFLTTTSRKSRPCTWSCA

SEQ ID NO: 331 - protein, 10 aa, Homo sapiens
FEFFLQCPAK

SEQ ID NO: 332 - protein, 24 aa, Homo sapiens
LCTICTSYVSPWIIFTEMEYFTEM

SEQ ID NO: 333 - protein, 33 aa, Homo sapiens
CGKSIWWLKELRVLMFLHLWDSMKQVALHQSNR

SEQ ID NO: 334 - protein, 23 aa, Homo sapiens
ASPSPSRNKSELLTSPRPLTLQS

SEQ ID NO: 335 - protein, 15 aa, Homo sapiens
LKDCISTKPISGIVP

SEQ ID NO: 336 - protein, 25 aa, Homo sapiens
VSEDGKVASDTCVTLHWPLGKFRFR

SEQ ID NO: 337 - protein, 35 aa, Homo sapiens
KFCNFILLFSLILSIKHISVFFHIFSAVILTQYRS

SEQ ID NO: 338 - protein, 13 aa, Artificial Sequence
  modified Homo sapiens FSP
GRCYQLPQLQGFL

SEQ ID NO: 339 - protein, 11 aa, Artificial Sequence
  modified Homo sapiens FSP
SKLYGDHFLLL

SEQ ID NO: 340 - protein, 21 aa, Homo sapiens
ARAIATRPGGWNRMGEPRGFC

SEQ ID NO: 341 - protein, 13 aa, Homo sapiens
EELFLLVSLAMFR

SEQ ID NO: 342 - protein, 22 aa, Homo sapiens
IPSRHMFSVTKIMLKETFKRRK

SEQ ID NO: 343 - protein, 22 aa, Homo sapiens
RRKIIPNCFWGKTESPSIFTTC

SEQ ID NO: 344 - protein, 41 aa, Homo sapiens
RTTTTSLKEEEGIILITESRSLALLFQSLMILICAGTKEPF

SEQ ID NO: 345 - protein, 33 aa, Homo sapiens
SSGGGLGLIMLPWSGVEIIICLKRIVKRRKRKN

SEQ ID NO: 346 - protein, 11 aa, Homo sapiens
TTKKSMIEWKI

SEQ ID NO: 347 - protein, 40 aa, Artificial Sequence
  modified Homo sapiens FSP
AGSATKMSTNAARRTGAASRSATTSRVASTVPAMAGPAKT

SEQ ID NO: 348 - protein, 9 aa, Homo sapiens
GSKKTGIMW

SEQ ID NO: 349 - protein, 16 aa, Homo sapiens
REKRQAVNMMCQHTMI

SEQ ID NO: 350 - protein, 27 aa, Homo sapiens
GLSLSYGPVSPIIRRLWNIFVRNQEKI

SEQ ID NO: 351 - protein, 17 aa, Homo sapiens
SSCFQRRKRRIYQHLRY

SEQ ID NO: 352 - protein, 68 aa, Homo sapiens
ALPHHPSPIARASWGLRPPAFLWALRILTPLPLPQPQPPAVATATVAATAAALLGLCPFPHHPIWPEV

SEQ ID NO: 353 - protein, 13 aa, Homo sapiens
SPSLQTQWRLKRS

SEQ ID NO: 354 - protein, 12 aa, Homo sapiens
TLVMVATVKLFL

SEQ ID NO: 355 - protein, 23 aa, Homo sapiens
LVCSALISLTLKGNLFTLLTLLM

SEQ ID NO: 356 - protein, 40 aa, Homo sapiens
VAFHPSQPGPCGRPTPKLPSPMRRQPSWQWAASPSTATTS

SEQ ID NO: 357 - protein, 26 aa, Homo sapiens
LVIPKLIILMEKTLTGCLRALKMNRF

SEQ ID NO: 358 - protein, 14 aa, Homo sapiens
TKSGKKQELTFLLL

SEQ ID NO: 359 - protein, 11 aa, Homo sapiens
ESPPAPSMPRC

SEQ ID NO: 360 - protein, 17 aa, Homo sapiens
RQTLRTLSLRGMVPRTL

SEQ ID NO: 361 - protein, 10 aa, Homo sapiens
TTSQSQLSSE

SEQ ID NO: 362 - protein, 9 aa, Homo sapiens
EMKKTTFIS

SEQ ID NO: 363 - protein, 25 aa, Homo sapiens
RFQMQPLSLMPAHWSICLLRDSMIW

SEQ ID NO: 364 - protein, 13 aa, Homo sapiens
VWKKMKSKTSCVV

SEQ ID NO: 365 - protein, 10 aa, Homo sapiens
SGRNLPTAPC

SEQ ID NO: 366 - protein, 18 aa, Homo sapiens
TWPTQTWTRLPRRSCCSR

SEQ ID NO: 367 - protein, 13 aa, Homo sapiens
HTSTLGKKSILLL

SEQ ID NO: 368 - protein, 26 aa, Homo sapiens
GIYFMLQTPTITRLKLWIQKQKTVQH

SEQ ID NO: 369 - protein, 13 aa, Artificial Sequence
  modified Homo sapiens FSP
LASSYSGIQQRKL

SEQ ID NO: 370 - protein, 31 aa, Homo sapiens
IHHLPGTIPLSSGARMCLLSQAPPAGSGGRR

SEQ ID NO: 371 - protein, 55 aa, Homo sapiens
GSPSRSAACGGRERRDRRPGPSRAHCPANGAGWPCPAVPLGPARTGLLPGEAAPS

SEQ ID NO: 372 - protein, 15 aa, Homo sapiens
CWTSHLMQMTRPWLN

SEQ ID NO: 373 - protein, 12 aa, Homo sapiens
QRKKSLKPSGSL

SEQ ID NO: 374 - protein, 8 aa, Homo sapiens
RTPPGGGR

SEQ ID NO: 375 - protein, 8 aa, Homo sapiens
EEKKKAHL

SEQ ID NO: 376 - protein, 15 aa, Artificial Sequence
  modified Homo sapiens FSP
ATVPTCSPRTLRCLP

SEQ ID NO: 377 - protein, 11 aa, Homo sapiens
IGDREQVKKTM

SEQ ID NO: 378 - protein, 9 aa, Homo sapiens
LSKKEKMTR

SEQ ID NO: 379 - protein, 28 aa, Homo sapiens
LSINNYRFQMKFYFRFTSHGSPFTSANF

SEQ ID NO: 380 - protein, 31 aa, Artificial Sequence
  modified Homo sapiens FSP
APFSPKVWRTARGASLSCQTTPPITLSSTPR

SEQ ID NO: 381 - protein, 8 aa, Homo sapiens
DYKKNTGI

SEQ ID NO: 382 - protein, 10 aa, Homo sapiens
IVALMSSTII

SEQ ID NO: 383 - protein, 12 aa, Homo sapiens
IPFFTGLTRMMR

SEQ ID NO: 384 - protein, 25 aa, Homo sapiens
EGRSSTNARSATVCLTAGTSSKITW

SEQ ID NO: 385 - protein, 14 aa, Artificial Sequence
  modified Homo sapiens FSP
SFIALIGRLMFQAC

SEQ ID NO: 386 - protein, 17 aa, Homo sapiens
NTMKWWELYLVILSHIA

SEQ ID NO: 387 - protein, 13 aa, Homo sapiens
SKPKRIKNLSLKT

SEQ ID NO: 388 - protein, 14 aa, Homo sapiens
SLNQRSYARPSCQP

SEQ ID NO: 389 - protein, 16 aa, Homo sapiens
MSPPFMPSRVLFMSRR

SEQ ID NO: 390 - protein, 26 aa, Artificial Sequence
  modified Homo sapiens FSP
IRVIEVARHKPLLRNLKKKKARILRK

SEQ ID NO: 391 - protein, 13 aa, Homo sapiens
PAGWPQAAPRPSA

SEQ ID NO: 392 - protein, 16 aa, Homo sapiens
MATSSHRFLEDMLPAK

SEQ ID NO: 393 - protein, 9 aa, Homo sapiens
ESPPASLKN

SEQ ID NO: 394 - protein, 12 aa, Homo sapiens
GPPPAPPISLAS

SEQ ID NO: 395 - protein, 10 aa, Homo sapiens
TQKKSYPIKT

SEQ ID NO: 396 - protein, 11 aa, Homo sapiens
NWISKKLNLTM

SEQ ID NO: 397 - protein, 9 aa, Homo sapiens
LYKKNSRRL

SEQ ID NO: 398 - protein, 14 aa, Homo sapiens
SIFLAKESSGRAYV

SEQ ID NO: 399 - protein, 13 aa, Homo sapiens
HQRCAASQQSASF

SEQ ID NO: 400 - protein, 9 aa, Homo sapiens
DLKKRRSAV

SEQ ID NO: 401 - protein, 17 aa, Homo sapiens
QLRLMLPSSARPWGPDG

SEQ ID NO: 402 - protein, 14 aa, Homo sapiens
NYNKEFLHQGQLEN

SEQ ID NO: 403 - protein, 15 aa, Homo sapiens
LQTWKKNHLTQTTLK

SEQ ID NO: 404 - protein, 10 aa, Homo sapiens
HITGGTGLLL

SEQ ID NO: 405 - protein, 10 aa, Homo sapiens
EEGGCASGTW

SEQ ID NO: 406 - protein, 29 aa, Homo sapiens
NQERSPDPSPDLHTGLIKSQRKTNTDVNF

SEQ ID NO: 407 - protein, 12 aa, Homo sapiens
AHQKRKQSCRCS

SEQ ID NO: 408 - protein, 9 aa, Homo sapiens
CHKKTSQLD

SEQ ID NO: 409 - protein, 16 aa, Homo sapiens
REFINLKMIKWTLLKS

SEQ ID NO: 410 - protein, 12 aa, Homo sapiens
IFYTWTNQYLQN

SEQ ID NO: 411 - protein, 13 aa, Homo sapiens
SLSPGPKRTQIWS

SEQ ID NO: 412 - protein, 22 aa, Artificial Sequence
  modified Homo sapiens FSP
NWMTMQTIIKNRTEAMPREHLL

SEQ ID NO: 413 - protein, 11 aa, Homo sapiens
EFFFTIGITWI

SEQ ID NO: 414 - protein, 11 aa, Homo sapiens
FPFFSSLEQCP

SEQ ID NO: 415 - protein, 8 aa, Homo sapiens
LYKKIEKN

SEQ ID NO: 416 - protein, 21 aa, Homo sapiens
HPSSTDGGLCEAPGLPTSSSL

SEQ ID NO: 417 - protein, 12 aa, Homo sapiens
LPLQPYLLPCLL

SEQ ID NO: 418 - protein, 11 aa, Homo sapiens
LIEQNLIGKKN

SEQ ID NO: 419 - protein, 11 aa, Homo sapiens
EHGGPPSSMPL

SEQ ID NO: 420 - protein, 11 aa, Homo sapiens
THWKRNPKAIW

SEQ ID NO: 421 - protein, 13 aa, Homo sapiens
GYTPQMEAGAGQW

SEQ ID NO: 422 - protein, 11 aa, Homo sapiens
LTKKIRNSCLI

SEQ ID NO: 423 - protein, 10 aa, Homo sapiens
QPPRRPSTAN

SEQ ID NO: 424 - protein, 10 aa, Homo sapiens
APKKTLLKCW

SEQ ID NO: 425 - protein, 9 aa, Homo sapiens
DMKKNCGSL

SEQ ID NO: 426 - protein, 9 aa, Homo sapiens
WTTGVPPSS

SEQ ID NO: 427 - protein, 11 aa, Homo sapiens
DSLKMVKNFLS

SEQ ID NO: 428 - protein, 9 aa, Homo sapiens
FLNPRKLGP

SEQ ID NO: 429 - protein, 9 aa, Homo sapiens
KTPPGGYPL

SEQ ID NO: 430 - protein, 14 aa, Homo sapiens
SPCWAWTPGGWAAS

SEQ ID NO: 431 - protein, 8 aa, Homo sapiens
QVPPSILH

SEQ ID NO: 432 - protein, 11 aa, Homo sapiens
VKPTLWEEGTS

SEQ ID NO: 433 - protein, 8 aa, Homo sapiens
YWAPHVTP

SEQ ID NO: 434 - protein, 11 aa, Homo sapiens
LLHFLVMLRII

SEQ ID NO: 435 - protein, 11 aa, Homo sapiens
NTLKNSFLLWP

SEQ ID NO: 436 - protein, 11 aa, Homo sapiens
ERQKIKKKPKR

SEQ ID NO: 437 - protein, 42 aa, Homo sapiens
GRRKRSEGGVKRKKENVCKRRKRNVGEKKRKGFDGRKRKGDG

SEQ ID NO: 438 - protein, 24 aa, Homo sapiens
YMKKNLTPSFAMKYLPPICTLGDQ

SEQ ID NO: 439 - protein, 13 aa, Homo sapiens
YSASGHGVRITKS

SEQ ID NO: 440 - protein, 19 aa, Homo sapiens
EMFVLNPCLPSIMLTSHNM

SEQ ID NO: 441 - protein, 14 aa, Homo sapiens
VPALKKLRSPLWIF

SEQ ID NO: 442 - protein, 55 aa, Homo sapiens
RQPEAATKSCVRSSCGGPSGDEPPPCLQQPDPRALSQAFSRSFPLFPSLAGKSMI

SEQ ID NO: 443 - protein, 48 aa, Homo sapiens
RTPTSPAATKSHSLRVFGWADALLNLVARVPSNLGDLFKSKVNPATML

SEQ ID NO: 444 - protein, 32 aa, Homo sapiens
REPRERLYQDTSLMMIVLTIQNAAFLSNIRMA

SEQ ID NO: 445 - protein, 29 aa, Homo sapiens
SKTQRRYKLSSLKEDLLQRSAFTSQAPLY

SEQ ID NO: 446 - protein, 45 aa, Homo sapiens
PGLRPSQHLLLYITLRVVKWIPALATASAWPAPSAKTVWHPTLLI

SEQ ID NO: 447 - protein, 28 aa, Homo sapiens
CHLASCPQCFHQWGRHHHSHRYQEWYLR

SEQ ID NO: 448 - protein, 11 aa, Homo sapiens
GATPQAAPTTS

SEQ ID NO: 449 - protein, 10 aa, Homo sapiens
VLTKQKVLYK

SEQ ID NO: 450 - protein, 10 aa, Homo sapiens
IKALLTLNSL

SEQ ID NO: 451 - protein, 9 aa, Homo sapiens
GTPPWMPFR

SEQ ID NO: 452 - protein, 49 aa, Homo sapiens
HRPPHSQQPFHSHCPSRSPQPSLRPHPHPLRAQGCNPSLSTTHRWYSWG

SEQ ID NO: 453 - protein, 64 aa, Homo sapiens
NYGHCNSPLAFLTQLLPRPTSNPWWMTRRDPFCGGNLISTKLENFVSGISAGTERRQMNLCFLY

SEQ ID NO: 454 - protein, 51 aa, Homo sapiens
RKHCCKRITLRSSCSLGRDLYLWNPRILKGSGGYTDVIMMDATKCTLKAPT

SEQ ID NO: 455 - protein, 47 aa, Homo sapiens
NSGSQSGTKMKATHSGGLKKKSFTVPKLLFPTQKFNLDLKACSIPED

SEQ ID NO: 456 - protein, 28 aa, Homo sapiens
RDQCFQMMEGKAFLPERKCFPGNQHPLG

SEQ ID NO: 457 - protein, 43 aa, Homo sapiens
AMRRPSSRHAAHRPLCQRFPTLTVSRWMTSLISSLRVERSPSP

SEQ ID NO: 458 - protein, 25 aa, Homo sapiens
CIWQPVMDTVILYRSYCSTRQTSMQ

SEQ ID NO: 459 - protein, 17 aa, Homo sapiens
NSLALCWVPACWVTCLH

SEQ ID NO: 460 - protein, 21 aa, Homo sapiens
LLQPCLKALSVPLWKMPSRAS

SEQ ID NO: 461 - protein, 13 aa, Homo sapiens
NPPLRFNLILMMY

SEQ ID NO: 462 - protein, 19 aa, Homo sapiens
TALGATIPSRPRSAAALRT

SEQ ID NO: 463 - protein, 12 aa, Homo sapiens
DAKKLVLLNWLP

SEQ ID NO: 464 - protein, 14 aa, Homo sapiens
GGRMRNIFTPAGHK

SEQ ID NO: 465 - protein, 10 aa, Homo sapiens
LCRNMKQQIY

SEQ ID NO: 466 - protein, 20 aa, Homo sapiens
GEWAALGPCWKSACRASRSA

SEQ ID NO: 467 - protein, 8 aa, Homo sapiens
CPGGALQW

SEQ ID NO: 468 - protein, 10 aa, Homo sapiens
EAKKRIMWLL

SEQ ID NO: 469 - protein, 13 aa, Homo sapiens
HTSWNFRPLNWRS

SEQ ID NO: 470 - protein, 36 aa, Artificial Sequence
  modified Homo sapiens FSP
VGAQLMLTSTSCSTMSCLSRPGWAALQRLTWVCRRP

SEQ ID NO: 471 - protein, 87 aa, Homo sapiens
RAPPKTAPETAAKFLKEGTERNTAESLQEKLGVTPGSWWMHLRSRFLSANAACECVRRLPCDGNTLPRRTSNFYVDVHEALVFDVCL

SEQ ID NO: 472 - protein, 29 aa, Homo sapiens
QLLSQTPRLPPCLHTEEPSHWTGGPRSPP

SEQ ID NO: 473 - protein, 29 aa, Homo sapiens
IAFHIKSIAAALKRHFTVNMSKVETGLHV

SEQ ID NO: 474 - protein, 31 aa, Homo sapiens
WKKTQADCFFGLLKKIGLPQCGDSFLKRPLT

SEQ ID NO: 475 - protein, 23 aa, Homo sapiens
AVFASSRPTSPASCRRPPSSWWR

SEQ ID NO: 476 - protein, 24 aa, Homo sapiens
TQRRLKNWKEKKCIELNILISWRI

SEQ ID NO: 477 - protein, 38 aa, Homo sapiens
RHNDGKNEKNWPNSMKPSYGSVATAASSGHCILCLVWR

SEQ ID NO: 478 - protein, 46 aa, Homo sapiens
TREKIKQPVAQWVMITKRPKENHQRKRRNVNIKKRLRIPSLRKYRQ

SEQ ID NO: 479 - protein, 50 aa, Homo sapiens
LPTPFCTTLRNFFLSSLILAVLCTNCIFRYTASFLQAFMLPGFLKHTKRK

SEQ ID NO: 480 - protein, 33 aa, Homo sapiens
LPILMMPSKKLILYLFLCCPTLSFWQREQPSRT

SEQ ID NO: 481 - protein, 29 aa, Homo sapiens
LSMIMYSLPLTYSNLHTLTILKKYMLSQN

SEQ ID NO: 482 - protein, 28 aa, Homo sapiens
CTPFCTLSAKHVPLSISGSPALELLGPW

SEQ ID NO: 483 - protein, 11 aa, Homo sapiens
LNQKNIPDLSI

SEQ ID NO: 484 - protein, 15 aa, Homo sapiens
VSPLAPCPPLEVHLH

SEQ ID NO: 485 - protein, 14 aa, Homo sapiens
STGRLTARRMPPCL

SEQ ID NO: 486 - protein, 8 aa, Homo sapiens
RPKKRTVL

SEQ ID NO: 487 - protein, 21 aa, Homo sapiens
VVKVWMRVKYTKEVIMDLTNV

SEQ ID NO: 488 - protein, 13 aa, Homo sapiens
FRFFRMRKWRDQI

SEQ ID NO: 489 - protein, 18 aa, Homo sapiens
HFWNSTKKRLRTMKIKCS

SEQ ID NO: 490 - protein, 13 aa, Homo sapiens
LPVLAPIMSRGRA

SEQ ID NO: 491 - protein, 13 aa, Homo sapiens
MTKKENANMIFKK

SEQ ID NO: 492 - protein, 12 aa, Homo sapiens
ALKKPLRKVRRL

SEQ ID NO: 493 - protein, 10 aa, Homo sapiens
DQFFWKMQLL

SEQ ID NO: 494 - protein, 196 aa, Artificial Sequence
  modified Homo sapiens FSP
APTVLGGPRWLCCTQNVASGNGPLLARPAGKPRAASLSSWKALGPSAASLRPSLRAPGRPVGASRPAQTQGSLPRRLLPPFCGQTWPGSWGSQESFICCADISTALPLGSSRPAPAPRHREHEHGHQARPPRLLFTSLMQLLWTQLTRHSPPTLHTGPHPSLHVAALSLLRMDSTLRQGASLFSLTLGGPGPWKDP

SEQ ID NO: 495 - protein, 120 aa, Artificial Sequence
  modified Homo sapiens FSP
RSVCSYAGSWGTALGRGQSLWRRRKRWLCAQTVRAATILLARRRRRSLDLRKRRRANRRMMMMIQRSLNHLLSSWKTGAWKTLTTCSQRRIIEPSPTTRPSASLSDPSLLPKIPRLLSPR

SEQ ID NO: 496 - protein, 9 aa, Artificial Sequence
  modified Homo sapiens FSP
RSWGTALGR

SEQ ID NO: 497 - protein, 104 aa, Homo sapiens
SGPTRRHSWAPKTSSLTRNPRRSLASPTRGKGSARGCGRSRTTLLSRLPAISPPRKRAVWKSLNQSPKLQRVTVIRRGMQRAAATRKGSWSLMSQPRRRTRKER

SEQ ID NO: 498 - protein, 57 aa, Homo sapiens
HLTTKGEGWVHQWGVTVGAQVATAPSMGTPHPLPHHPSMALTPTALCSWSMAWINLR

SEQ ID NO: 499 - protein, 64 aa, Artificial Sequence
  modified Homo sapiens FSP
TCRAIVTMTSCLYLRTTEGHPVGAIPPHSASYPTYPTHFSTWEPVPSDRPAGALPRCSPLRTEG

SEQ ID NO: 500 - protein, 75 aa, Artificial Sequence
  modified Homo sapiens FSP
RRRKRRDIQENQRTLLKIQNCTYPGSPAWRLVAFLSLVARLWKASDLSVRKRNTYGWKLSMARVIENSASKQKIH

SEQ ID NO: 501 - protein, 60 aa, Homo sapiens
GCFWPCLWNSLLRFCPASCSGCYSWTIPPTGSPFSCTTTRSSMNPTSLTPGRSSRTTSQL

SEQ ID NO: 502 - protein, 52 aa, Homo sapiens
CTTSRGHCTGSPRPCTPFAISCTAHKWNGKTPTWSLPKSTSRWKGPSSCCRR

SEQ ID NO: 503 - protein, 33 aa, Homo sapiens
KQTRRRKLLLLCKKNQILKKKGEKLKHCFKAWG

SEQ ID NO: 504 - protein, 33 aa, Homo sapiens
CPLLLVYIMSTTGWLERAYGRLWRPTAIRQTLY

SEQ ID NO: 505 - protein, 52 aa, Artificial Sequence
  modified Homo sapiens FSP
SLLVPRRLLPYTLPHSAHGSRRTSTCQHPTTTNTSSSSSSQMWCRPRSSCIR

SEQ ID NO: 506 - protein, 45 aa, Homo sapiens
SLPPLMSAVATLCQNTPMVSPLGAPLARNCTQHPSPLWLGTLRDT

SEQ ID NO: 507 - protein, 71 aa, Homo sapiens
QRKIMDTRQGKVHTSTDSSWRAPAGTPKQEPLLKPVSRSWHALCRSSLQKPPPWTDKKPNRPTSALCIEPN

SEQ ID NO: 508 - protein, 41 aa, Homo sapiens
MKLTLAVLPTLRNLHCYPQLCLQGRLAARNANMNLEILLGV

SEQ ID NO: 509 - protein, 27 aa, Homo sapiens
CSIKPPLPRRWTTVLREPWHGMQEIRP

SEQ ID NO: 510 - protein, 15 aa, Homo sapiens
RTGPWTPLLPPSCPW

SEQ ID NO: 511 - protein, 32 aa, Homo sapiens
NMETFQSMSWPILTIFLTSMRTIIPEFCLNEF

SEQ ID NO: 512 - protein, 16 aa, Homo sapiens
LGQIIMKKMRRPVCYK

SEQ ID NO: 513 - protein, 37 aa, Homo sapiens
LPPPSHRAPHSPPPSQHRRAQDQPHSCLCPRRTGCCV

SEQ ID NO: 514 - protein, 22 aa, Homo sapiens
SVSRPEACGIRTSLLVRRMRRQ

SEQ ID NO: 515 - protein, 15 aa, Homo sapiens
LQKKEIAKNVFVQNI

SEQ ID NO: 516 - protein, 11 aa, Homo sapiens
IIKKNPALPKH

SEQ ID NO: 517 - protein, 14 aa, Homo sapiens
GFKMQSRRRKWAGN

SEQ ID NO: 518 - protein, 19 aa, Homo sapiens
SATTTTVILEIIIMDRVIP

SEQ ID NO: 519 - protein, 12 aa, Homo sapiens
AASGAAEAAELL

SEQ ID NO: 520 - protein, 12 aa, Homo sapiens
ITKKRNWLRSWL

SEQ ID NO: 521 - protein, 14 aa, Homo sapiens
RRKNKKQPTFFLWQ

SEQ ID NO: 522 - protein, 16 aa, Homo sapiens
VTIRIQKQKFRILKRI

SEQ ID NO: 523 - protein, 14 aa, Homo sapiens
RKENTVKRPNLPHL

SEQ ID NO: 524 - protein, 9 aa, Homo sapiens
IEKKERKNL

SEQ ID NO: 525 - protein, 10 aa, Homo sapiens
LTLFSLKVWE

SEQ ID NO: 526 - protein, 11 aa, Homo sapiens
ILIVCRKSFYS

SEQ ID NO: 527 - protein, 11 aa, Homo sapiens
LISHLMKWAHP

SEQ ID NO: 528 - protein, 8 aa, Homo sapiens
SLFFSYCF

SEQ ID NO: 529 - protein, 11 aa, Homo sapiens
TLNWKRNLLFG

SEQ ID NO: 530 - protein, 13 aa, Homo sapiens
TLNWKRGPSVVPW

SEQ ID NO: 531 - protein, 48 aa, Homo sapiens
TLNWKREPRLSYLKTMYSSLFWSQFPFLQCCHHHHLHHHYHHVLNKYI

SEQ ID NO: 532 - protein, 226 aa, Artificial Sequence
  modified Homo sapiens FSP
QTQLPKVWDPVFFGAASPPSCTWADWLCGAWACAATCSQPSSSRQHRSALMTFLLASWCVPKVSCQGVRRPWNSLPRSTWHSVLMCHQLCSDTSSIVAGQATHQWPGSCPRCASRPRRERTAAWQLCCRRPSRTTFRSQQPSWQGCCPGSTGACWLSARHLRRPCSGARPVPAGVWPAASASTSTPSRQLHRVRPRACMPCPGSSGSSGACTRCRRSGWLGRLHVA

SEQ ID NO: 533 - protein, 88 aa, Homo sapiens
HHLVPLFIWTPWRKSGSGSGLNAWNGFSNLVRLMGPWHLCMGLKSWISVPCPNLLPAPSALVLLAPATPPFGLIPRLPTGLYCFPSSD

SEQ ID NO: 534 - protein, 66 aa, Homo sapiens
LKRQMGSSLLVSMKNPYHLLGPHSLMVTIKWSSRKRYCILQVSHYMMKKGKRDKLPFLLLINFHSA

SEQ ID NO: 535 - protein, 63 aa, Homo sapiens
IFHSGMLPLEIALTISPFSTVCRESERDYNMDFLTLRHLMWMNMNIMSELKMVTSTGLFQENF

SEQ ID NO: 536 - protein, 115 aa, Homo sapiens
PMFYVGPLMCLLTGVFVISGSHLFCTAPAMSDSSPSVTCCRVQPSWWLSPTAGFWRPWPAPCTLSSSATCCSLMWLLSSHFGSCCISSFTMGLSVKCRYTPGLCLSQPFSSLFSP

SEQ ID NO: 537 - protein, 105 aa, Homo sapiens
GSLLSPPERRCGSRLWRAWRRFPLLMMWRTPMTTRLRTQACRRNSSRPRPAGRAPRSLATRPWPRRTGGCLLWRGRCSHRRGGCPWCPRKPRSWPRSACEPGRSP

SEQ ID NO: 538 - protein, 140 aa, Artificial Sequence
  modified Homo sapiens FSP
SRASWVPPQPCRCSMGQPCPRRCCSSPCRPRARRSPASWETHPWAPSSLGPSQPTPSSGSCLQEGACPRSCRPGEGSHHPCCHPCLALLGVTGRPWAWVPQRLWGSEALASEASRKTVGLCRRPLGSHCWGSPPRTTGFP

SEQ ID NO: 539 - protein, 48 aa, Homo sapiens
AALTSSAISGPGWTPRPPTFLSPWPSPAIPLLTPRMSWCSSLTTWPNS

SEQ ID NO: 540 - protein, 80 aa, Homo sapiens
LCSPPSPQNRSRTNGSVTTSATEAWCRTTLPASQRSSACTRSTLMSCTEASRDPAKMRRRSWQRRRLPSVIPTRTARWPR

SEQ ID NO: 541 - protein, 98 aa, Homo sapiens
LVNLKKLWERKKNQSQLLPHALLEEEVVAVENEVARKMILTGGPGFRRVTFHGTTRISGCSSSGLLCSGVESCFTCCSRDPGEKSLGRTLSITIFQKE

SEQ ID NO: 542 - protein, 102 aa, Artificial Sequence
  modified Homo sapiens FSP
VSGSPPAGSSTQAHASVDSRRERVKAVPALAHLVGWGVLISLWRTNDRRVHINSILTQSCFLDFGVEAFYRKESSDVILAFLEAKDSGSPEVRGSRPAWPTW

SEQ ID NO: 543 - protein, 87 aa, Homo sapiens
YIQVKKLISVKNVENVLVVGIISLFITKAYTLERKCGKNIKQHFINVMFVRKFLKANQVWKCIFERIQVKNHTSVKFAISLLELRKH

SEQ ID NO: 544 - protein, 50 aa, Homo sapiens
QGQARDLRCPLTAPLACLHLPSPPVRSTVCAMDSLRPVRLQKYPQAAAVP

SEQ ID NO: 545 - protein, 93 aa, Artificial Sequence
  modified Homo sapiens FSP
ASLLSRSSMSLVRTWSSKLNRHQSLALPVPQGPSGALWKNLRKPPGVTKGPGKVKVSPLGDSCSPRGQQEPGGPAVWKILFWSARRSLVSPGW

SEQ ID NO: 546 - protein, 45 aa, Homo sapiens
RRWPRPRRSAVSCFRITRGPRAASPETSTRPPVLPASPRTSPWSP

SEQ ID NO: 547 - protein, 60 aa, Homo sapiens
SRSSATLPGRRRRRWLRRRRQPISVAPAGPPRRPNQKPNPPGGARCVIMRPTWPGTSAFT

SEQ ID NO: 548 - protein, 30 aa, Homo sapiens
RESRAMISLGALREDWNQKRSLGQQIPVVI

SEQ ID NO: 549 - protein, 57 aa, Homo sapiens
RSINTEVNIRNINIPQKKTRIKNINISINIRNTKEKRLLMLLIKRVCLQQKELNLMI

SEQ ID NO: 550 - protein, 94 aa, Homo sapiens
ASVPGSGPSTQTPLTFTPALCSLRRLRPSMSSTGRHTPCEHRTQATLACPGARRQLPRNFLGERALGLPSPLRVSKWDDSRPRKTRGSLGLPEL

SEQ ID NO: 551 - protein, 76 aa, Artificial Sequence
  modified Homo sapiens FSP
WSPPQPRPPRDAAGFSVSVRDSREEPGGSSPRGAMLRAGLSSVTIPACNISVNSEMDLGPLTPRTQPWARARGRRK

SEQ ID NO: 552 - protein, 39 aa, Homo sapiens
QPPKALQPPRAPQLPNAPQPPSIPQPPRAPQPLKLLQCL

SEQ ID NO: 553 - protein, 29 aa, Homo sapiens
GLTMSPLWPSCPWTGCRCWKPCAGTGLAP

SEQ ID NO: 554 - protein, 45 aa, Artificial Sequence
  modified Homo sapiens FSP
TLESALEKGFMNLANVGKPAAVSAPLFSCKESAVNVGNLLAKPLI

SEQ ID NO: 555 - protein, 38 aa, Homo sapiens
LLKNSLQRLFVLELGVSLIQMTCRGWHTFWSTWYSWVV

SEQ ID NO: 556 - protein, 16 aa, Homo sapiens
LLKNSNCRACFCCGQS

SEQ ID NO: 557 - protein, 18 aa, Homo sapiens
HLLLSLHPSLPKLPQNPL

SEQ ID NO: 558 - protein, 51 aa, Homo sapiens
REIRCVQAVVILCSELSSVHEVLSSCVALFKGAREHICLRETYRLISTIAI

SEQ ID NO: 559 - protein, 30 aa, Homo sapiens
NVKNPKVILIFLMKKQPSKVRRKEAHGLPL

SEQ ID NO: 560 - protein, 32 aa, Homo sapiens
TRTREVSPRHSTLTASRRSSTASTSWEGWPPG

SEQ ID NO: 561 - protein, 48 aa, Homo sapiens
ICPWKRQPGAVAQRIGSHLVPTATLFLLNQHLGKTVRRTVLEWRLTCW

SEQ ID NO: 562 - protein, 36 aa, Homo sapiens
QTLRPWLWLTAWAASTGACGRRQLGANARCSSGMRC

SEQ ID NO: 563 - protein, 33 aa, Homo sapiens
RRTKPAALSPVMVPRQKYQQRVKRSSADPLPLC

SEQ ID NO: 564 - protein, 17 aa, Homo sapiens
RLVRGRRLRTAENVKNN

SEQ ID NO: 565 - protein, 17 aa, Homo sapiens
LDPMAPHRSPTNKLLPQ

SEQ ID NO: 566 - protein, 25 aa, Homo sapiens
NSKKPPQSKRTNGMKMNMKGPEGRR

SEQ ID NO: 567 - protein, 56 aa, Homo sapiens
LPVNVHLVSHSITLLVSTTTNVGLNLRFVEQRESVKTLQAVSAVNAKEGSLLMPPD

SEQ ID NO: 568 - protein, 24 aa, Homo sapiens
SRGQRSLVSADESTTHLRNARKTK

SEQ ID NO: 569 - protein, 16 aa, Homo sapiens
FVKWLKKEEKEVQLQD

SEQ ID NO: 570 - protein, 33 aa, Homo sapiens
GLQTKRTLRIRKPRVLKPLQFRLASQILPTLSK

SEQ ID NO: 571 - protein, 12 aa, Homo sapiens
QTEIVSGILAYC

SEQ ID NO: 572 - protein, 22 aa, Homo sapiens
VATPGRPWPPSFSAPCCWRLWP

SEQ ID NO: 573 - protein, 33 aa, Homo sapiens
ASSPSLLVGANRSSAMGRTGGGCQWWHHFWVPI

SEQ ID NO: 574 - protein, 11 aa, Homo sapiens
SYALSNKNLLI

SEQ ID NO: 575 - protein, 62 aa, Homo sapiens
MALHGVQLRKSKDLHFLLQGCCLMLKRVWIPMQLIAALMTIWMNIPLEKMWQLTVVLNGSGL

SEQ ID NO: 576 - protein, 18 aa, Homo sapiens
LKPAAPRGPIRAKTASIF

SEQ ID NO: 577 - protein, 12 aa, Homo sapiens
KMLKRTKCFTFG

SEQ ID NO: 578 - protein, 21 aa, Homo sapiens
RERTRINRKELRLYHPDTHHA

SEQ ID NO: 579 - protein, 13 aa, Homo sapiens
RIPPHHPRCLRDA

SEQ ID NO: 580 - protein, 19 aa, Homo sapiens
HHHQCQPWSPTLPRTPLLP

SEQ ID NO: 581 - protein, 21 aa, Homo sapiens
MQKKKSSREIRKRRRMMMMRR

SEQ ID NO: 582 - protein, 13 aa, Homo sapiens
WMRRLEERWENKL

SEQ ID NO: 583 - protein, 8 aa, Homo sapiens
AQKKNRRH

SEQ ID NO: 584 - protein, 20 aa, Homo sapiens
RSERKWSWMTLPGSWSMRRT

SEQ ID NO: 585 - protein, 8 aa, Homo sapiens
SLKKQYPK

SEQ ID NO: 586 - protein, 21 aa, Homo sapiens
KLFLVREVQRGEKQELRRIKQ

SEQ ID NO: 587 - protein, 18 aa, Homo sapiens
LVAISFKTVFKASHAAKT

SEQ ID NO: 588 - protein, 22 aa, Homo sapiens
ELVSTGIMTFHLLSVDIYQEAT

SEQ ID NO: 589 - protein, 18 aa, Homo sapiens
NSDQNLFTEIILNPPKHQ

SEQ ID NO: 590 - protein, 10 aa, Homo sapiens
SRKRAVSNSR

SEQ ID NO: 591 - protein, 18 aa, Homo sapiens
MAPSSAAADQDSGCWMTW

SEQ ID NO: 592 - protein, 18 aa, Homo sapiens
HNGYVLQKKLHFTFYTCL

SEQ ID NO: 593 - protein, 13 aa, Homo sapiens
QPPPRSEVLSCPL

SEQ ID NO: 594 - protein, 13 aa, Artificial Sequence
  modified Homo sapiens FSP
RALAALPSSSTLR

SEQ ID NO: 595 - protein, 11 aa, Homo sapiens
DHKKMYSAHSC

SEQ ID NO: 596 - protein, 11 aa, Homo sapiens
SSKKISKMIFV

SEQ ID NO: 597 - protein, 18 aa, Homo sapiens
QSHRPPRASSAGDLQCQA

SEQ ID NO: 598 - protein, 23 aa, Homo sapiens
SVGCLGCPGSRLPRSAPSPMSMR

SEQ ID NO: 599 - protein, 20 aa, Homo sapiens
STVREALSPVQHGKCRKRRN

SEQ ID NO: 600 - protein, 26 aa, Homo sapiens
AAKFARCATALEHVSSSLRLRTRTRT

SEQ ID NO: 601 - protein, 30 aa, Homo sapiens
TSALDVSAPAAMIAACSAALLSAWARWNVC

SEQ ID NO: 602 - protein, 11 aa, Homo sapiens
QDRIFRVFQNH

SEQ ID NO: 603 - protein, 20 aa, Homo sapiens
ETDTSSAFSSLLPLRNLSQL

SEQ ID NO: 604 - protein, 15 aa, Homo sapiens
MEKTQQMGRRMEHIL

SEQ ID NO: 605 - protein, 12 aa, Homo sapiens
RKLFSSKRKKKK

SEQ ID NO: 606 - protein, 13 aa, Homo sapiens
ADKKHVQSVTSVP

SEQ ID NO: 607 - protein, 14 aa, Homo sapiens
RRKNQRCLTFQPFT

SEQ ID NO: 608 - protein, 11 aa, Homo sapiens
KTVFLNHWRGS

SEQ ID NO: 609 - protein, 12 aa, Homo sapiens
KKKKNMKPSLLL

SEQ ID NO: 610 - protein, 9 aa, Homo sapiens
CGPPAWALC

SEQ ID NO: 611 - protein, 10 aa, Homo sapiens
RRYFWKRQEM

SEQ ID NO: 612 - protein, 11 aa, Homo sapiens
DGWGATAPTRG

SEQ ID NO: 613 - protein, 10 aa, Homo sapiens
RGGILLSMFL

SEQ ID NO: 614 - protein, 9 aa, Homo sapiens
QESPRSPLL

SEQ ID NO: 615 - protein, 10 aa, Homo sapiens
KRKKAARKLT

SEQ ID NO: 616 - protein, 9 aa, Homo sapiens
THFFTFFNL

SEQ ID NO: 617 - protein, 11 aa, Homo sapiens
EVVFWMTSGLI

SEQ ID NO: 618 - protein, 12 aa, Homo sapiens
MRKLAFPQFSSC

SEQ ID NO: 619 - protein, 8 aa, Homo sapiens
VSKKDLSP

SEQ ID NO: 620 - protein, 9 aa, Homo sapiens
SIGFLLQNL

SEQ ID NO: 621 - protein, 10 aa, Homo sapiens
EVKKPPVCSR

SEQ ID NO: 622 - protein, 21 aa, Homo sapiens
LLFIPTGISLVETAREQLFRG

SEQ ID NO: 623 - protein, 13 aa, Homo sapiens
AVPPHVKRHAVNL

SEQ ID NO: 624 - protein, 38 aa, Homo sapiens
TCSPQSLLSSWRSTQPHVPPSTLWGVRMTSLSASTSLW

SEQ ID NO: 625 - protein, 11 aa, Homo sapiens
VNLFLTKMMRM

SEQ ID NO: 626 - protein, 12 aa, Homo sapiens
ALKKRRMVLLKS

SEQ ID NO: 627 - protein, 233 aa, Homo sapiens
WLAPPEAGAARGAEAAAVVTAAFTKEASKKAMGPLDEAPGKSSAARAGMTEARGGLRSQQGGMEHDVALRREGLAQGRSTPAQTARTGAPYGRNRRRRRRAAGGSEQGPGETATAGAPPALMVVPALLAGGNMGNGGASLNLICEGIEEGVVKRRGGEGEAALTCGGAERLKALRRTRMGSQSGAWTMRMKKWAPLMPLGPSCLSRRAPRSPFLRSRSWTSKGWRRRRNLPKG

SEQ ID NO: 628 - protein, 70 aa, Homo sapiens
NDLRKNKEQPAKTGPSQKRTGRRGGSIKVLIPTMEHRTGFTLAATGTEITSICLTFIKMHTSQGVWLIYK

SEQ ID NO: 629 - protein, 78 aa, Homo sapiens
YCHLRLPSQAPLKGKRAQNQAQPNLLPQNQHHLLRQWTQTVQAPRFPLLKSRSSWIQPLWSQELWMPSQWRVLEILTN

SEQ ID NO: 630 - protein, 38 aa, Homo sapiens
HNPRHQTSVLSFTTANTVPTAIGQLWECLSTTRKDTQK

SEQ ID NO: 631 - protein, 23 aa, Homo sapiens
MFLIQRELLKTLNMIQVLMSVVH

SEQ ID NO: 632 - protein, 15 aa, Artificial Sequence
  modified Homo sapiens FSP
TTSSLVASSQNWGQP

SEQ ID NO: 633 - protein, 11 aa, Homo sapiens
MGEKNQSLWTS

SEQ ID NO: 634 - protein, 24 aa, Homo sapiens
LPVYRQTHWRLYPKPFAGLFPLKP

SEQ ID NO: 635 - protein, 97 aa, Homo sapiens
QPARQARAQDRWRTQRPGPASSPGSRSPSHVRHLHHGWASVPGLPKVAMAPGTPGIRGPHAPPTWLPARPSRLPGSAAAPTLPRALARLPPAVGGCV

SEQ ID NO: 636 - protein, 24 aa, Homo sapiens
RSVKRCKRSLPKGIVKLTLQIYNI

SEQ ID NO: 637 - protein, 14 aa, Homo sapiens
GNFQRTTCHSILSS

SEQ ID NO: 638 - protein, 15 aa, Homo sapiens
LKPYRSVLVLIKMFF

SEQ ID NO: 639 - protein, 8 aa, Homo sapiens
DEKKRKQK

SEQ ID NO: 640 - protein, 23 aa, Homo sapiens
FGRSLNLTVKWLVTSGKRVTSIR

SEQ ID NO: 641 - protein, 19 aa, Homo sapiens
SWCLCCRLIAMKEMTWTKI

SEQ ID NO: 642 - protein, 12 aa, Homo sapiens
KPPPTHPDRGVE

SEQ ID NO: 643 - protein, 82 aa, Artificial Sequence
  modified Homo sapiens FSP
VTPPVARMGRSPTSKPWGMRRAETQTAAPRHLPKQSPDASPPVAPPAWTRPGSTAVSHPGSTPGAPSLATAVPSPLDSSAMS

SEQ ID NO: 644 - protein, 48 aa, Homo sapiens
ANPQLLCQNPEKLALKEDLLYLRTSGEPWDTERNLRPLSLQCQSLALP

SEQ ID NO: 645 - protein, 40 aa, Homo sapiens
NPHFRPPRTWRATTSAQLARCSPWATLPHMPRARSSTAAA

SEQ ID NO: 646 - protein, 37 aa, Homo sapiens
TTAQTAPPSTRMMATCPCPQGWPQCPVAERAVETICP

SEQ ID NO: 647 - protein, 41 aa, Homo sapiens
HPLPTLTCPTMPGRTPTANPPTPSAASYLWPSRTLQPSACQ

SEQ ID NO: 648 - protein, 29 aa, Homo sapiens
EATSNQDLLQMVPCSMQDPLLSLWTLFTE

SEQ ID NO: 649 - protein, 38 aa, Homo sapiens
NVNVCSPKILILKHQKMIRDFRRNLRKWLKSYKGKKQI

SEQ ID NO: 650 - protein, 36 aa, Homo sapiens
ANQEISIVKTIVVCLKVGCVILKMTVVMAAMKKIAQ

SEQ ID NO: 651 - protein, 16 aa, Homo sapiens
AAPMMSSMACGSAESS

SEQ ID NO: 652 - protein, 24 aa, Homo sapiens
RLFWMRRLWCFRQLSGDISRGQSS

SEQ ID NO: 653 - protein, 13 aa, Homo sapiens
EQKKISPFIYFFL

SEQ ID NO: 654 - protein, 11 aa, Homo sapiens
KLKKASVLLFS

SEQ ID NO: 655 - protein, 11 aa, Homo sapiens
DTQIPRTSRWC

SEQ ID NO: 656 - protein, 9 aa, Homo sapiens
SVKKRMIIF

SEQ ID NO: 657 - protein, 10 aa, Homo sapiens
RVPFLFVVQV

SEQ ID NO: 658 - protein, 8 aa, Homo sapiens
LEVGATSS

SEQ ID NO: 659 - protein, 94 aa, Homo sapiens
SRSPKSMSPPGRTQLPPSQLPQPHRHRKTCSRRATPLSSLAAAPGARAGARHPPPTRRQRSLCSSQPSQPRPRSCLGTPLAGLPACPSPCPPVR

SEQ ID NO: 660 - protein, 16 aa, Homo sapiens
RHPPPTRRPSQPRPRS

SEQ ID NO: 661 - protein, 70 aa, Homo sapiens
PLSGTWGTLRAPSSFHPLVATQALLSQRGHPRTALGGSQPLSPRRAAAPTQQLPHALLAPSLQDLAKRPP

SEQ ID NO: 662 - protein, 17 aa, Homo sapiens
RAWAPAPPTRCVWQQPS

SEQ ID NO: 663 - protein, 30 aa, Homo sapiens
TRKASAASCASGVTTSTHRPASAWTSMHQT

SEQ ID NO: 664 - protein, 36 aa, Artificial Sequence
  modified Homo sapiens FSP
VLTVACRSAQPPRPWDHAAPVTCTCGRTRGLGGGTT

SEQ ID NO: 665 - protein, 44 aa, Homo sapiens
KTKNLPLKTKLKKKENKTTLNLQMAEHHLLCPRIMNKAQPYGIC

SEQ ID NO: 666 - protein, 43 aa, Homo sapiens
HPIHIGCTQTMVMGIIFMCLRLCPHILDRLQRGLPGNWELKLE

SEQ ID NO: 667 - protein, 35 aa, Homo sapiens
VSSTHSTTTGSHWKQPTDGAVCTRTSMRSFPTRST

SEQ ID NO: 668 - protein, 27 aa, Homo sapiens
HTWNGPRIGVNVGFSGQTFELLLMLMY

SEQ ID NO: 669 - protein, 21 aa, Homo sapiens
RIKPFSTNSVLRRTGSSIEEL

SEQ ID NO: 670 - protein, 21 aa, Homo sapiens
VTWMKRRRRNLILRKPEWIFK

SEQ ID NO: 671 - protein, 10 aa, Homo sapiens
LEKKESEKWM

SEQ ID NO: 672 - protein, 18 aa, Homo sapiens
VSNWRVKSLPCLPFFSVL

SEQ ID NO: 673 - protein, 9 aa, Homo sapiens
GCTPQLCWT

SEQ ID NO: 674 - protein, 20 aa, Homo sapiens
TFLLWKNWKRALSTRKICSK

SEQ ID NO: 675 - protein, 10 aa, Homo sapiens
EEKKTEHYAY

SEQ ID NO: 676 - protein, 12 aa, Homo sapiens
FLQGVALAVQAS

SEQ ID NO: 677 - protein, 9 aa, Homo sapiens
LMFFCGHQN

SEQ ID NO: 678 - protein, 10 aa, Homo sapiens
IRKKADLHTQ

SEQ ID NO: 679 - protein, 48 aa, Homo sapiens
GAPRSPSSVAGSSSATWQSGAMWVQPPWEQLPGGSCTLRMGLMSTTAS

SEQ ID NO: 680 - protein, 126 aa, Homo sapiens
IRTPGHGSPPARWESPWPVHTRPRSSPGMNSEHSGSAGVVALSRLAMVQSHPMSLSLWPGPSRGHQRSSSLAFPPAGAPWVNSESGGRWRWTRATARPSPWGSHTAPSLGLSEPPPPSSGTSWGQP

SEQ ID NO: 681 - protein, 56 aa, Artificial Sequence
  modified Homo sapiens FSP
TLWTLCSSTPTCLRTCHLMRSLWPPQRPSNSRKFGWQMRASTPAPCLTHCTFWTRL

SEQ ID NO: 682 - protein, 27 aa, Homo sapiens
PPPGWLPRLTRERAAAALRAVGTQISI

SEQ ID NO: 683 - protein, 76 aa, Artificial Sequence
  modified Homo sapiens FSP
SIKKKKNKEGVGREVLVVVVPVAIAELVVLVVLSLALHTVLAQVVLLKGKRDTVGVDLQQSKLDVAGVEAILAELK

SEQ ID NO: 684 - protein, 20 aa, Homo sapiens
LQDGSLDRNLGSPLMSEFRK

SEQ ID NO: 685 - protein, 30 aa, Homo sapiens
RNSYRMDQTFKILYLVILQTGAPGMNIKET

SEQ ID NO: 686 - protein, 43 aa, Homo sapiens
TLSHQIKSSFGQKMGKVIFTNYLPVAFQLVIHSAVMWGRQLKI

SEQ ID NO: 687 - protein, 21 aa, Homo sapiens
LHYLMRWPINLIRRWTSFWEI

SEQ ID NO: 688 - protein, 28 aa, Homo sapiens
TGTKHESGLLKTSQKLSLKKMTQGPCLG

SEQ ID NO: 689 - protein, 24 aa, Homo sapiens
RHPPGSTRYPSFPLRLVPLSLIGP

SEQ ID NO: 690 - protein, 35 aa, Homo sapiens
KRSSRLGWASGRITYSHSPPRGWCSAAWPPRHGWC

SEQ ID NO: 691 - protein, 44 aa, Homo sapiens
TSRPCTSTSTTSLLPMALLCVKRGRRCTKAKATAVSAAVSTEQI

SEQ ID NO: 692 - protein, 13 aa, Homo sapiens
WFAFLSIKKRAAR

SEQ ID NO: 693 - protein, 25 aa, Homo sapiens
LRMSLILSVICSCSWELWGYMICHI

SEQ ID NO: 694 - protein, 26 aa, Homo sapiens
TPSSDPESPGMLARSTPSTTGRWCAL

SEQ ID NO: 695 - protein, 13 aa, Homo sapiens
YITLLYLRKIFKV

SEQ ID NO: 696 - protein, 19 aa, Homo sapiens
QDTLRNLLLQTTLTCWWIH

SEQ ID NO: 697 - protein, 20 aa, Homo sapiens
NTHPLLQACSPSACRCPCHQ

SEQ ID NO: 698 - protein, 14 aa, Artificial Sequence
  modified Homo sapiens FSP
NLQIRRLPRQRLLS

SEQ ID NO: 699 - protein, 26 aa, Homo sapiens
CIHITGMSLLGLHGTMEKSEGMKSFH

SEQ ID NO: 700 - protein, 20 aa, Homo sapiens
GNTANGPGIGRKSLMPMQVT

SEQ ID NO: 701 - protein, 36 aa, Homo sapiens
EAFTLTMVGFSKLISHVLLSYKPFSKGKEHERIPES

SEQ ID NO: 702 - protein, 11 aa, Homo sapiens
GSWGVPWMTSM

SEQ ID NO: 703 - protein, 13 aa, Homo sapiens
TSGTKSSRKSMNS

SEQ ID NO: 704 - protein, 13 aa, Homo sapiens
SSKKRKKGNMWTT

SEQ ID NO: 705 - protein, 19 aa, Homo sapiens
DVAGEENEGPPRPSLMCPR

SEQ ID NO: 706 - protein, 12 aa, Homo sapiens
PEIFLRMNWCVS

SEQ ID NO: 707 - protein, 22 aa, Homo sapiens
HLHRMLYMNRLQPSTQWYKITA

SEQ ID NO: 708 - protein, 12 aa, Homo sapiens
GLPQKELKGIQL

SEQ ID NO: 709 - protein, 11 aa, Homo sapiens
KKKKSNIPKTP

SEQ ID NO: 710 - protein, 21 aa, Homo sapiens
VSPAFLNFMDLLLTIKLELCV

SEQ ID NO: 711 - protein, 9 aa, Homo sapiens
NIIFLSDPG

SEQ ID NO: 712 - protein, 14 aa, Homo sapiens
SPSRAHLWPTRRSS

SEQ ID NO: 713 - protein, 12 aa, Homo sapiens
NMVKMLVFILKL

SEQ ID NO: 714 - protein, 10 aa, Homo sapiens
IAMTMDQYPF

SEQ ID NO: 715 - protein, 13 aa, Homo sapiens
PPFFTIDLVTTCI

SEQ ID NO: 716 - protein, 8 aa, Homo sapiens
CKKKNDGT

SEQ ID NO: 717 - protein, 10 aa, Homo sapiens
MTGFLTPRDF

SEQ ID NO: 718 - protein, 13 aa, Homo sapiens
LPPPWTAQLPCIS

SEQ ID NO: 719 - protein, 11 aa, Homo sapiens
RLIEIKVPSQK

SEQ ID NO: 720 - protein, 11 aa, Homo sapiens
GEKKYNVFHMK

SEQ ID NO: 721 - protein, 8 aa, Homo sapiens
KAFFLPVR

SEQ ID NO: 722 - protein, 109 aa, Artificial Sequence
  modified Homo sapiens FSP
AHPRPPALSLRSLQRSPALRARWSTSFCLAPKRPLLLTPREQTWLDPDPANAPCRCSAPANQPRTESPPPLPADLPHSSGLALCGIVSTSSHLILLWLLGSRMAHPRLP

SEQ ID NO: 723 - protein, 131 aa, Artificial Sequence
  modified Homo sapiens FSP
STATAPWTSASSTRSAKWATSTGARCLTSGAAAACWRRCSATSRGRARSPRVRSRTLPKLCLWWMTNLTTRRSTRRSCWTSPGMHTQTSRAPQPSRAQTWRTSPHCGIDTPVWLSQNCLRAPLTRTGRGLC

SEQ ID NO: 724 - protein, 70 aa, Homo sapiens
VKTGSSWTGSCRQGWRWSGSDCGISITTTTPRGACGASAAGRALARGRLEDGQPLPAPVGVPRQLLGAGL

SEQ ID NO: 725 - protein, 13 aa, Homo sapiens
SATRMPGPVPAPS

SEQ ID NO: 726 - protein, 40 aa, Homo sapiens
GPPTAQCQHPPEPLFLQADQATCLRGFARIASSCHPHHQF

SEQ ID NO: 727 - protein, 57 aa, Homo sapiens
GPPTVTRPPTPTTEPSPPTSTTLWSSAFSATRMPGIPAGLGLGFGRAEGAQEGKARV

SEQ ID NO: 728 - protein, 81 aa, Artificial Sequence
  modified Homo sapiens FSP
TGGRRMTRRTMTTTKMMMMRRTKRRRRKRRRMTMMTRRTLLTKKTCLTPRTSAATKALPRQTISQRRPIQTPPGTSLAIWG

SEQ ID NO: 729 - protein, 68 aa, Artificial Sequence
  modified Homo sapiens FSP
VPGLRAKVWRGSPEWDPERRCLLPLPSCAGPGDQARMRTSAVSCCRSPWTPCEHFPRPRSCGWRWWRE

SEQ ID NO: 730 - protein, 16 aa, Artificial Sequence
  modified Homo sapiens FSP
TYGAWASRWWSWQQDS

SEQ ID NO: 731 - protein, 117 aa, Artificial Sequence
  modified Homo sapiens FSP
QTPPSRTMTSGPTYGAWASRCPARLPPRWSWQQDSFPTRTARRTLRSSPKSYRKSPRFCPDTWASRGTSSPSSKTALLKITGRDQSIISYLNTWRWTWRPGSRMSWRRLSHRGLAAS

SEQ ID NO: 732 - protein, 32 aa, Homo sapiens
WVLICLDLFRQKFRKPLMLQESLFQMIFSSIF

SEQ ID NO: 733 - protein, 95 aa, Artificial Sequence
  modified Homo sapiens FSP
LPMPPPPRRPLPPPPRAAQRTVTRGKRLNNRAPLGEATGSRRQGEQNTEDSRKAKPDFWKVQNSFGSLVPEREKMLVPGGTRVCQHAKIGPCYMK

SEQ ID NO: 734 - protein, 64 aa, Homo sapiens
NRFRLCITILPGMKMSWSSEKVMSLMSWKSVMTAGLWGPQEEPNSLVLSPETTSRGCELRSLLL

SEQ ID NO: 735 - protein, 66 aa, Homo sapiens
LLLRILRLRRHLPPAAGLPVTGSPRSFTDTITYRDSRFLRPSKRPSWYNILTVNRPVVILARTQTT

SEQ ID NO: 736 - protein, 81 aa, Homo sapiens
LPLPPVPFLDCLSCPGRNAWWLQVPGELGTLADRERGPWSPTHSAQSPVPLRIHFCPVHRPPWHGLMAADRAWGLFTPAPT

SEQ ID NO: 737 - protein, 42 aa, Homo sapiens
DQWCPDGSHLGQPRQLPRDRRPRTSHISALIAARGLCSAAAS

SEQ ID NO: 738 - protein, 23 aa, Homo sapiens
NLAIVEEEMFLVMGELNYVPLAL

SEQ ID NO: 739 - protein, 52 aa, Homo sapiens
PYFWRTLQPMEMHFFFCQHFPSGPTRVPLSKYTTRSKSLKQDKRFYFSIPST

SEQ ID NO: 740 - protein, 44 aa, Homo sapiens
RRCEVQHSSVTREKTGCGFSAVNKTQEVFWWKNTLYLIKIHYMK

SEQ ID NO: 741 - protein, 22 aa, Homo sapiens
PQPGNQRSNRSLPGTTRMRHRV

SEQ ID NO: 742 - protein, 52 aa, Homo sapiens
TRTSLHQATRKHIIIPLERRSPQAHKLWMIVIIKDIFLMKRFLTLASAHVGV

SEQ ID NO: 743 - protein, 42 aa, Homo sapiens
GSLLGLSLAQPEALKVAARLRCQHPQHHHRRRVQCSLSRVRR

SEQ ID NO: 744 - protein, 30 aa, Homo sapiens
GSNSNLGMKCGIQNQMLVIQQEAGFGILHT

SEQ ID NO: 745 - protein, 40 aa, Artificial Sequence
  modified Homo sapiens FSP
QSQGGGAGGESQRANSARRPLGRIQGRCRAAGPACGRGRA

SEQ ID NO: 746 - protein, 31 aa, Homo sapiens
PEQLTLPISQQKPSPVLGKLEMVKAVQLRVA

SEQ ID NO: 747 - protein, 58 aa, Homo sapiens
FMRNFLNMLCFENILLHLHQIMKFLLRQPGQGIWKLRLIQPSLWLSLWIRPNLLLFHI

SEQ ID NO: 748 - protein, 32 aa, Artificial Sequence
  modified Homo sapiens FSP
HPQSHLHPLGLPHLPHPHCQTTRAPCQDWPLP

SEQ ID NO: 749 - protein, 62 aa, Homo sapiens
PPAGKNLMKSPQWWGSSVHLAWSSQSLSLHGSAVRENHPSLTRLLHTSLCMCLRELIFTLKT

SEQ ID NO: 750 - protein, 53 aa, Homo sapiens
MEYCPPLNSCASVCASWSLDGCHPLWSWHSSRAGRAGGQGAQDCPCIAELWQC

SEQ ID NO: 751 - protein, 44 aa, Homo sapiens
LWLWAGWTVWWSCGPGEKGHGWLPSLPTMALLLLRFSCMRVASY

SEQ ID NO: 752 - protein, 44 aa, Homo sapiens
VMPLHHGLTQKMISETCSVRSFMDLKIKLAMKIGGVSLTSFLFP

SEQ ID NO: 753 - protein, 29 aa, Homo sapiens
AAATTLTSAASSAGSSWTPGRRGGTCASS

SEQ ID NO: 754 - protein, 22 aa, Homo sapiens
NLLVSTQLGTAASPTQHQQLPR

SEQ ID NO: 755 - protein, 27 aa, Homo sapiens
WREAWRRSSWPRWTMAWAQHGSPAIGG

SEQ ID NO: 756 - protein, 54 aa, Homo sapiens
SVSRKAGLVSSTKPLVQLGFTLKRYRSFLNIEFLQTPKLTRKLSEWSRRKLLTC

SEQ ID NO: 757 - protein, 32 aa, Homo sapiens
VVKTVALGHLTIRNVASVDPGQTVLWMESLCL

SEQ ID NO: 758 - protein, 9 aa, Homo sapiens
CHWGAAPGS

SEQ ID NO: 759 - protein, 25 aa, Artificial Sequence
  modified Homo sapiens FSP
GPVYYVCNHMNVSSVLKPSLFTVPI

SEQ ID NO: 760 - protein, 30 aa, Homo sapiens
TSQRIPCSLQKKMHLKYGLFSTFYLRTSIH

SEQ ID NO: 761 - protein, 27 aa, Homo sapiens
ALQVFSSTGLKRTLIERVSMDTAFRES

SEQ ID NO: 762 - protein, 12 aa, Homo sapiens
PAPATQAPCMMT

SEQ ID NO: 763 - protein, 31 aa, Homo sapiens
KTAKTLCGHRMDPQPRSCSSLWSWQLKPCPC

SEQ ID NO: 764 - protein, 34 aa, Homo sapiens
LVKVQTHISVIPSLESSPLGVQDWGNPSALIQNS

SEQ ID NO: 765 - protein, 32 aa, Homo sapiens
LLWEDRAKNTQALPLPLSGEALSIGPALQLKV

SEQ ID NO: 766 - protein, 28 aa, Homo sapiens
RKSLILCKTNLLVFINDSRRHLDSMEKF

SEQ ID NO: 767 - protein, 22 aa, Homo sapiens
WTRSQKGKASLTIGGWRICCSL

SEQ ID NO: 768 - protein, 24 aa, Homo sapiens
RHPLQSLHHPPCSLSAATQAIPPR

SEQ ID NO: 769 - protein, 40 aa, Homo sapiens
VRILEISSHFLHILRSQKMIQLNLTVMKKILLLFFHHHLV

SEQ ID NO: 770 - protein, 38 aa, Homo sapiens
NLRNQSVAMADWREMKSVIVVLRLNVDLQAVVIFELVY

SEQ ID NO: 771 - protein, 25 aa, Homo sapiens
RIKASSMPQTPERQTLPHLTSLPSR

SEQ ID NO: 772 - protein, 20 aa, Homo sapiens
LRTKLCFAPCTNQREFMSKN

SEQ ID NO: 773 - protein, 44 aa, Homo sapiens
RKSPVTGNMRHWPCLKDRKQAERPGLICRNPSLLWAWMMKLHNY

SEQ ID NO: 774 - protein, 13 aa, Homo sapiens
VIPPIQCFILMYF

SEQ ID NO: 775 - protein, 13 aa, Homo sapiens
KEKKSRTLMKMIS

SEQ ID NO: 776 - protein, 24 aa, Homo sapiens
HPLPKMNTTRMGIWISPGAGPGLH

SEQ ID NO: 777 - protein, 12 aa, Artificial Sequence
  modified Homo sapiens FSP
NKWNAMVVLNKG

SEQ ID NO: 778 - protein, 19 aa, Homo sapiens
QRPLPGNGVRKAQNGWCRH

SEQ ID NO: 779 - protein, 21 aa, Homo sapiens
LWSSRHTSLRITHKRHGSIPL

SEQ ID NO: 780 - protein, 13 aa, Homo sapiens
SQEILVIALLLKR

SEQ ID NO: 781 - protein, 15 aa, Homo sapiens
TWRKLADSLVCSWIT

SEQ ID NO: 782 - protein, 12 aa, Homo sapiens
CHLVSTCQTIPS

SEQ ID NO: 783 - protein, 11 aa, Homo sapiens
LEILRRSSLGR

SEQ ID NO: 784 - protein, 27 aa, Homo sapiens
LENLDSRQKFPFDLIIMANMYQWIRVR

SEQ ID NO: 785 - protein, 16 aa, Homo sapiens
LPIMPCWSPCLAGSLW

SEQ ID NO: 786 - protein, 11 aa, Homo sapiens
MSLLQRTVSQQ

SEQ ID NO: 787 - protein, 8 aa, Homo sapiens
KQKKNWQS

SEQ ID NO: 788 - protein, 19 aa, Artificial Sequence
  modified Homo sapiens FSP
MLKNVRGNNSKLKYRRKRK

SEQ ID NO: 789 - protein, 22 aa, Homo sapiens
SAIKQRKQRTMWSGKPSLWSSG

SEQ ID NO: 790 - protein, 13 aa, Homo sapiens
KEKKLRLAVLVNN

SEQ ID NO: 791 - protein, 14 aa, Homo sapiens
GLASPLAACRLTSP

SEQ ID NO: 792 - protein, 11 aa, Homo sapiens
ISKKQNALAEH

SEQ ID NO: 793 - protein, 13 aa, Homo sapiens
GQKKIRKTSQVLT

SEQ ID NO: 794 - protein, 11 aa, Homo sapiens
SEKCRSSLDWR

SEQ ID NO: 795 - protein, 10 aa, Homo sapiens
EKMCWFRTGM

SEQ ID NO: 796 - protein, 13 aa, Homo sapiens
AHKKAMKKATKSS

SEQ ID NO: 797 - protein, 10 aa, Homo sapiens
FTPFLVHKMF

SEQ ID NO: 798 - protein, 20 aa, Homo sapiens
AGRAAPAPSPRTAAACPTPV

SEQ ID NO: 799 - protein, 9 aa, Homo sapiens
VRYPRARPR

SEQ ID NO: 800 - protein, 9 aa, Homo sapiens
QLLKMRSWN

SEQ ID NO: 801 - protein, 11 aa, Homo sapiens
VIHFKKSKIIW

SEQ ID NO: 802 - protein, 12 aa, Homo sapiens
GPTPLLLSSGFY

SEQ ID NO: 803 - protein, 10 aa, Homo sapiens
NQLTRDWKAS

SEQ ID NO: 804 - protein, 11 aa, Homo sapiens
LIEEFTHLCSL

SEQ ID NO: 805 - protein, 12 aa, Homo sapiens
AVEKSPHLRWLI

SEQ ID NO: 806 - protein, 12 aa, Homo sapiens
SLPNLKHCLMMS

SEQ ID NO: 807 - protein, 10 aa, Homo sapiens
AGSGSDTQRD

SEQ ID NO: 808 - protein, 8 aa, Homo sapiens
TDKKVWLM

SEQ ID NO: 809 - protein, 11 aa, Homo sapiens
IVKKGEEGGRM

SEQ ID NO: 810 - protein, 15 aa, Homo sapiens
TSMTSTWTGLLRSRC

SEQ ID NO: 811 - protein, 8 aa, Homo sapiens
DCQKSHSS

SEQ ID NO: 812 - protein, 9 aa, Homo sapiens
RAFFISHSL

SEQ ID NO: 813 - protein, 8 aa, Homo sapiens
LNQKNSVI

SEQ ID NO: 814 - protein, 11 aa, Homo sapiens
QLQKTAPGLNI

SEQ ID NO: 815 - protein, 12 aa, Homo sapiens
KGKKNVLRLTSC

SEQ ID NO: 816 - protein, 10 aa, Homo sapiens
LKKILQDYQS

SEQ ID NO: 817 - protein, 10 aa, Homo sapiens
FFTTCGNRRS

SEQ ID NO: 818 - protein, 11 aa, Homo sapiens
LAQWAPAASPA

SEQ ID NO: 819 - protein, 10 aa, Homo sapiens
LAGRAMGRAP

SEQ ID NO: 820 - protein, 8 aa, Homo sapiens
TGKKNCSI

SEQ ID NO: 821 - protein, 10 aa, Homo sapiens
KDLFCRGISL

SEQ ID NO: 822 - protein, 8 aa, Homo sapiens
GTPPSPVS

SEQ ID NO: 823 - protein, 36 aa, Homo sapiens
WQCLEPSRFYVPWEASVVTFFAAGSAKMSCQSWLAP

SEQ ID NO: 824 - protein, 23 aa, Homo sapiens
STSASCSSSFSLVMTLTLDTWRL

SEQ ID NO: 825 - protein, 15 aa, Homo sapiens
RPENSQINSSLCNEA

SEQ ID NO: 826 - protein, 8 aa, Homo sapiens
IRKKRCVY

SEQ ID NO: 827 - protein, 58 aa, Homo sapiens
TTLAFQKSLPWPKLLPKTRSMTHLTEKPRKKSLLGPLTQIHQILLSKFSFFQLLCTRD

SEQ ID NO: 828 - protein, 11 aa, Homo sapiens
MNLPFGSFMSQ

SEQ ID NO: 829 - protein, 8 aa, Homo sapiens
PDPPTGIG

SEQ ID NO: 830 - protein, 11 aa, Homo sapiens
LCKKIMMRSIQ

SEQ ID NO: 831 - protein, 10 aa, Homo sapiens
TPRTGGPRCW

SEQ ID NO: 832 - protein, 11 aa, Homo sapiens
PTFFISPNKTH

SEQ ID NO: 833 - protein, 18 aa, Homo sapiens
HKWLKFCLLRVVKESFHE

SEQ ID NO: 834 - protein, 214 aa, Homo sapiens
VAAPSPGCTLARAPSTPVKTVWATHRARVPPACLLHSWISLKSSCQFNKMASTHYHTSEGQQGQGPGQRQGRALPQSPAVRALAASGTWFILCRSSLPSPTLWRRRGSGTIMGPRLREEVALEETATPARALEAPTPPITTITTTITTTTSPGTARGARARTARGMGGTRPSPQAGGVPMTTWTVIAASWRVGGPLGSLVVPSAWRVQMGPTGT

SEQ ID NO: 835 - protein, 140 aa, Artificial Sequence
  modified Homo sapiens FSP
SLRKKRRKSPITRNLRHWPCLKDHKWAVRLGLICRNPGLLWACMVKLQEYQHLLIKTSLRKKRKSPITRNLRQWPCLRASRVHTLKDHRWAVRLGLWKAVQLLKGSRNPTVQRRSSKGHECLVMIFQCPVRTLRAHSLIQ

SEQ ID NO: 836 - protein, 90 aa, Homo sapiens
QHCPPVPGSASLFHRRRTQGHPALHQCLSLTMSSAWPPTVTIWMCRHPRPQLSLTLPQLSLTQPQPPVKVRTKAAGGPCLPRRAPQGVNP

SEQ ID NO: 837 - protein, 39 aa, Homo sapiens
LGSIRGLNGNQMRMESLPSTAGTENGTSRQQLLRKTWSF

SEQ ID NO: 838 - protein, 14 aa, Homo sapiens
TVLSLVTISRFVLS

SEQ ID NO: 839 - protein, 19 aa, Homo sapiens
NSNIQLMTTRNFWPMASAI

SEQ ID NO: 840 - protein, 13 aa, Homo sapiens
WEKKRGTKSMKVT

SEQ ID NO: 841 - protein, 12 aa, Homo sapiens
STFFHEDLVRIP

SEQ ID NO: 842 - protein, 8 aa, Homo sapiens
WEKKWVRS

SEQ ID NO: 843 - protein, 11 aa, Homo sapiens
NVPLTKLSEVF

SEQ ID NO: 844 - protein, 17 aa, Homo sapiens
LWDPSRRRTTTVPISTS

SEQ ID NO: 845 - protein, 11 aa, Homo sapiens
LQKKISWNLSL

SEQ ID NO: 846 - protein, 9 aa, Homo sapiens
KEKKQWKKN

SEQ ID NO: 847 - protein, 154 aa, Artificial Sequence
  modified Homo sapiens FSP
VPLPRSLLRQPVQLRTEPARSSCISTASTTESTPTASSAMAVTRSSRGCWPAPSRPTASTPAGRGAFPPKCCSGMCTSHHAPWPSGPRTSTAVPGSACQGAVTPTSAEIWFLPSPDALSMGSSSPQWLGTLLWTFCGLRWGCPWPPCSSWRQPQ

SEQ ID NO: 848 - protein, 29 aa, Homo sapiens
QELKEAVKFSIVKNNSNNKCGIQPGLPIL

SEQ ID NO: 849 - protein, 16 aa, Homo sapiens
VSGSWSLGHPWCCLGL

SEQ ID NO: 850 - protein, 22 aa, Homo sapiens
LTLNSLRWPLQLSNLAGSQISW

SEQ ID NO: 851 - protein, 29 aa, Artificial Sequence
  modified Homo sapiens FSP
SERCLLVCLLSLCKMGPTILLTFGVHQMG

SEQ ID NO: 852 - protein, 12 aa, Homo sapiens
RPCWSRCSLRQM

SEQ ID NO: 853 - protein, 34 aa, Homo sapiens
CVGCQFIVPTRGAPLMARVHTEHSRVLLSPSFTC

SEQ ID NO: 854 - protein, 19 aa, Homo sapiens
NYRKLYQKQLEKRIKHLCS

SEQ ID NO: 855 - protein, 11 aa, Homo sapiens
SATPLPHYLAH

SEQ ID NO: 856 - protein, 11 aa, Homo sapiens
TSSLTMESSGH

SEQ ID NO: 857 - protein, 12 aa, Homo sapiens
LMFFGNQSIITL

SEQ ID NO: 858 - protein, 11 aa, Homo sapiens
LNHQKGKFMNF

SEQ ID NO: 859 - protein, 160 aa, Homo sapiens
AIRGLTVASSLPWTTPASGGVSRYISRCAPPATAWTSWPTATWWACATRRMKLRSWLRRWRFKTAPMKMGRCSCGQGSCSTISQNHTPTVRLLELPTTEHCPLTSATSCELGMVVRTTSSPCSRATASHPPGCHCGKVSTSTPTFLARPLPWPLPSTQMS

SEQ ID NO: 860 - protein, 85 aa, Homo sapiens
RGRTSGRSLSCCPRPRCRPAVASRSTAPSPRAGSRRCCLRTSCGAARPRRTRSAWGDWVASPPTRSSSRTACGAASPPARSWSAP

SEQ ID NO: 861 - protein, 60 aa, Homo sapiens
LHLYLQDLDFIFINKGLHLKHSIQDVQFMKITMAKQLLKIPCMTPTQSQWKGRRYDLIPT

SEQ ID NO: 862 - protein, 105 aa, Homo sapiens
HTATKAYTSPHAEGEFCPGETDTPDMGEGLSGNTETKRERGFRTSPPFISKPQRALWSPPCPSPGPPSLTSGLSCSWCAPCTGAGWVGKWAGLQLPFYPQWQLPP

SEQ ID NO: 863 - protein, 63 aa, Homo sapiens
EKACGHPPTDRAETLLKFLLKGILALAIGPAGALAGPVLTTLGTQRPLPWAAPCPATASPSPL

SEQ ID NO: 864 - protein, 35 aa, Artificial Sequence
  modified Homo sapiens FSP
AAARWKACLWPVAPRCSRWPPAILPASTPPSAPPT

SEQ ID NO: 865 - protein, 31 aa, Homo sapiens
TALPRSSSQGSVWQLPGNGLQSQAGALRMIS

SEQ ID NO: 866 - protein, 23 aa, Artificial Sequence
  modified Homo sapiens FSP
QQVPGLMKTGPSWMEAWNQMGPT

SEQ ID NO: 867 - protein, 25 aa, Homo sapiens
ASRWNPLRRTRALRGPPRQRAAAPH

SEQ ID NO: 868 - protein, 21 aa, Homo sapiens
YSYPSSLSVFSVPGYHLYYFR

SEQ ID NO: 869 - protein, 21 aa, Homo sapiens
IFYIFSWICPPTKKQRHKIQL

SEQ ID NO: 870 - protein, 19 aa, Homo sapiens
SIQHLQAPSPSLWPWNMLC

SEQ ID NO: 871 - protein, 12 aa, Homo sapiens
SASKNGNKKNSR

SEQ ID NO: 872 - protein, 9 aa, Homo sapiens
ESLKNTLNQ

SEQ ID NO: 873 - protein, 12 aa, Homo sapiens
NTLNQSPEHATR

SEQ ID NO: 874 - protein, 19 aa, Homo sapiens
LTDFFVLWKASGTIQFNCK

SEQ ID NO: 875 - protein, 10 aa, Homo sapiens
LAAFLNFVMH

SEQ ID NO: 876 - protein, 12 aa, Homo sapiens
PPKKFSILPSSR

SEQ ID NO: 877 - protein, 22 aa, Homo sapiens
WDQRKRKMGKVISKGNDLSKTG

SEQ ID NO: 878 - protein, 10 aa, Homo sapiens
WASTIRDRCV

SEQ ID NO: 879 - protein, 11 aa, Homo sapiens
CQLIENVPLLL

SEQ ID NO: 880 - protein, 12 aa, Homo sapiens
KTPPGLLRNTQQ

SEQ ID NO: 881 - protein, 10 aa, Homo sapiens
AGARGEIAVM

SEQ ID NO: 882 - protein, 10 aa, Homo sapiens
EKIPRGPSAS

SEQ ID NO: 883 - protein, 10 aa, Homo sapiens
QLPKMAPFMM

SEQ ID NO: 884 - protein, 9 aa, Homo sapiens
KDKKQIMKC

SEQ ID NO: 885 - protein, 165 aa, Artificial Sequence
  modified Homo sapiens FSP
TNALTLAQWSPVIAASPSASTQARCATSAAATTSPPTSAPTQAKSPSPATSVEESLPGAMNARGIPRSTCGRRTRKQTKVLWPLRPPPLSLPTRPRLLPLTRPRLLPLIHPRPPPHTHLPAPRPTHPLCTVASPPRRWPPRTPLFPLLSRPRSAASLAPPQGFRT

SEQ ID NO: 886 - protein, 49 aa, Artificial Sequence
  modified Homo sapiens FSP
GAWELGGLARWGPLCTHPQCQVLLLVEDVLCAKWFICPASFNPQNDSMR

SEQ ID NO: 887 - protein, 34 aa, Artificial Sequence
  modified Homo sapiens FSP
RNLILMIKVHKFLHNLSKYTDKLQKARMLLPPKA

SEQ ID NO: 888 - protein, 80 aa, Homo sapiens
RKQLYIQNALNLSRPHSARLTASDTTRTRTCRTWRRSSASAASAWRRSFAASCTRGTSCTPWRAKISTMSTYREKLSGFP

SEQ ID NO: 889 - protein, 100 aa, Homo sapiens
LPWMVPWGMEALGSWGQTDLTVLGQPGVRALGKWLQWPHPDPAGSPRPGPRGGHPQPRPSTPASPGNRGLPLPPPVWAVLAWARAHLAVEACLRTHGCSG

SEQ ID NO: 890 - protein, 35 aa, Homo sapiens
SRPRHRVRKRRCPHCRSSLPGRHRLQSCRPSPDPR

SEQ ID NO: 891 - protein, 40 aa, Homo sapiens
APACHWLARLGWRVSEEPVLSSLTSLRIELLLSSCSSRWG

SEQ ID NO: 892 - protein, 62 aa, Homo sapiens
MKMACGKRSLLQEVKKHELPKKAPSWPDRPLVGLARIQIWILHLLGLRPPSLLSVFQMTFIK

SEQ ID NO: 893 - protein, 42 aa, Homo sapiens
AAAPRSTPRATRPSCAGPSRRAARASTAKSASSRMASTSCAA

SEQ ID NO: 894 - protein, 38 aa, Homo sapiens
RAGNFAIMEIQCPALRKTLPILFGSLRRQNMSLEMWCR

SEQ ID NO: 895 - protein, 38 aa, Homo sapiens
RVWSFLFLRQRATSTITIACTKESLNSQNSSFIFSLLI

SEQ ID NO: 896 - protein, 17 aa, Homo sapiens
KDQRIIKVAPLVEDKMI

SEQ ID NO: 897 - protein, 34 aa, Homo sapiens
IAQLMKDQRIIKVPQIVCGLRIVLRKKRTVFLRQ

SEQ ID NO: 898 - protein, 31 aa, Homo sapiens
IQDQDQELATVLLQSALDCIFGVEEMATKKH

SEQ ID NO: 899 - protein, 58 aa, Homo sapiens
PSLNLISHQSSVGCSKGIWRAPEMTLFSTPTFAASSPWASMSWVSSGCSLPLWSSSCC

SEQ ID NO: 900 - protein, 42 aa, Homo sapiens
CTLGGSVTQKLKMTATGVPVIPPLVISWWAGTRSLWLLLPVG

SEQ ID NO: 901 - protein, 40 aa, Homo sapiens
GGTGTDMTTQKLMMVPNQCKLELELSLRNYALESSQVPMK

SEQ ID NO: 902 - protein, 28 aa, Homo sapiens
NLLQKEIPLLQLSLLTDSKRNHGHPQLT

SEQ ID NO: 903 - protein, 23 aa, Homo sapiens
NVLCKQQNGLPAPEHVGWEYLTG

SEQ ID NO: 904 - protein, 17 aa, Homo sapiens
GKGMKKIKKCLHANQQE

SEQ ID NO: 905 - protein, 18 aa, Homo sapiens
NNLCQRLHWRLRHVIVLI

SEQ ID NO: 906 - protein, 13 aa, Homo sapiens
EQLFLKLQEANGI

SEQ ID NO: 907 - protein, 27 aa, Homo sapiens
MLTALPPAMTAMCGYGIRGNPVQQWNI

SEQ ID NO: 908 - protein, 19 aa, Homo sapiens
LNVTCFVIFRRVRNELQKW

SEQ ID NO: 909 - protein, 28 aa, Homo sapiens
VIMSITGKKEESNRSKALSEATPFHWIT

SEQ ID NO: 910 - protein, 27 aa, Artificial Sequence
  modified Homo sapiens FSP
LAVSAVTGRARSLGLSKVSSEPGLMST

SEQ ID NO: 911 - protein, 16 aa, Homo sapiens
LKTFHMKCFLNLSQME

SEQ ID NO: 912 - protein, 8 aa, Homo sapiens
PDKKSRNC

SEQ ID NO: 913 - protein, 9 aa, Homo sapiens
NIRARQEGN

SEQ ID NO: 914 - protein, 13 aa, Homo sapiens
LSNIRARQEGKSG

SEQ ID NO: 915 - protein, 21 aa, Homo sapiens
ARGTSPIRHCSHSSSCSGPSS

SEQ ID NO: 916 - protein, 20 aa, Homo sapiens
FREKRNYVKKKSKLKKKEKK

SEQ ID NO: 917 - protein, 22 aa, Homo sapiens
SRTALITHTLCCWLTWAQVSAF

SEQ ID NO: 918 - protein, 21 aa, Homo sapiens
RRRSLPCGWTLLYLSSAWRMK

SEQ ID NO: 919 - protein, 9 aa, Homo sapiens
LRPPWPSWS

SEQ ID NO: 920 - protein, 18 aa, Homo sapiens
IQASTSPSSQHGCMRDLP

SEQ ID NO: 921 - protein, 10 aa, Homo sapiens
EVTRCCFFHK

SEQ ID NO: 922 - protein, 20 aa, Homo sapiens
APSLTFSPSGLMEIWISASV

SEQ ID NO: 923 - protein, 15 aa, Homo sapiens
VILQVRSTACENSPK

SEQ ID NO: 924 - protein, 12 aa, Homo sapiens
ISKKCSLSHQEK

SEQ ID NO: 925 - protein, 18 aa, Homo sapiens
LRFLRTMKQWPKFCSAGI

SEQ ID NO: 926 - protein, 11 aa, Homo sapiens
TPLKNEDFISC

SEQ ID NO: 927 - protein, 10 aa, Homo sapiens
WTCLKMSIGA

SEQ ID NO: 928 - protein, 11 aa, Homo sapiens
DGWGAMALTRG

SEQ ID NO: 929 - protein, 11 aa, Artificial Sequence
  modified Homo sapiens FSP
AWKAVLVERGP

SEQ ID NO: 930 - protein, 16 aa, Homo sapiens
NSLGIIWPKSGLILTA

SEQ ID NO: 931 - protein, 14 aa, Homo sapiens
PWKNSESMKKVKCI

SEQ ID NO: 932 - protein, 12 aa, Homo sapiens
IYIFCLHYGTQL

SEQ ID NO: 933 - protein, 9 aa, Homo sapiens
FSKKARKQS

SEQ ID NO: 934 - protein, 12 aa, Homo sapiens
QNKKVMSMEMIL

SEQ ID NO: 935 - protein, 10 aa, Homo sapiens
SQKTVSSGKV

SEQ ID NO: 936 - protein, 10 aa, Homo sapiens
YSKKAKERQN

SEQ ID NO: 937 - protein, 11 aa, Homo sapiens
INKKTSRIFPA

SEQ ID NO: 938 - protein, 11 aa, Homo sapiens
LNKMNSGWSLK

SEQ ID NO: 939 - protein, 9 aa, Homo sapiens
LAFFTTYMA

SEQ ID NO: 940 - protein, 10 aa, Homo sapiens
RSQGAGPVAT

SEQ ID NO: 941 - protein, 11 aa, Homo sapiens
KVKKQDPKPIN

SEQ ID NO: 942 - protein, 10 aa, Homo sapiens
LVGGAGHGRW

SEQ ID NO: 943 - protein, 193 aa, Homo sapiens
SVSCGSNTTTCIWLPHPRRTRACRWSFLSSIRWCRCFPSTSRSWRRRASGTTLLSSTSCWTSSWTSATPRPPTARSCRSTSLRKATSWKQGPRGHQPPSPTRCPGGPKASSIGRMRCSWTSSSLSTSWVNTQEWDGWVTRSAPTAMSCAARSWAPSRCESSSRACPSCAWASTTRSSLTTRAAAKANPWSWRM

SEQ ID NO: 944 - protein, 16 aa, Homo sapiens
SSSLSTSWSAPTAMSC

SEQ ID NO: 945 - protein, 82 aa, Homo sapiens
RTPASCVRTLTWTWQWSVPIRECSSTKASVARQPPGCSWRSRSTLSLSGGAWSMPRNGPWETPSMSKQNRGLRLIKSSSTKS

SEQ ID NO: 946 - protein, 174 aa, Artificial Sequence
  modified Homo sapiens FSP
SSSRTPRRQRSSTTPPASSGTSAQPLRPLARRCGSATGWWTPWSPLSTTPWTRANARTRAWRTRCASCGTCPTASTTRCRRPRCSGWRVAAAGTWRGRRRERSWAASRRRAGGCASCPSPPMRSPSRRCPRTPRASSGCGAPRSWGCTTGCCSAARPPGRCRTSRQATAGGRGC

SEQ ID NO: 947 - protein, 60 aa, Homo sapiens
GPSWTWGRAPRTESSQPRGSSSCSARWCLGRCCCSGNDGRTRSSGWMPGMNMKMKTFMKA

SEQ ID NO: 948 - protein, 163 aa, Artificial Sequence
  modified Homo sapiens FSP
SLLVWPVGRNWQLAGPLTPTRGLTRTTHPGVPRGSLMTWPLTGHQRGAWPPGLPPEPEVPPALECWDPTPQSPSWPLQFLGPLAPAHHSGSHSEYPMSSSGLPCSWWWTQATPAPTWTTSSRLARAPRASCASPPCAARASWWPSRRWTCASSRGASCSSTRW

SEQ ID NO: 949 - protein, 74 aa, Homo sapiens
MDTLALHDPHPMATSGGLSLHPDPLPGHQFPLEAHFEALSLSKFTFSFLLLHFPNIFSIPWTNQRCCSSLGQRY

SEQ ID NO: 950 - protein, 52 aa, Homo sapiens
NKETFWCERVMGNLVNMSFLYILMDRGDILSYNMLITCIDSRALGFQTFLNL

SEQ ID NO: 951 - protein, 38 aa, Homo sapiens
CHPLWEQLDTEPTPRLCSARKENQRWSLRPAARRPWRS

SEQ ID NO: 952 - protein, 58 aa, Homo sapiens
CYLHHWNYLSFLKGQIIREMSFHLLNYRTSNISHQWIRLHFQKALEIKHISKGVHRVG

SEQ ID NO: 953 - protein, 103 aa, Artificial Sequence
  modified Homo sapiens FSP
WCSPDSSSSPRTRSSGCPSYAGRRPTQSLSQPGWCPLSRPSWPPLPATSSPPPASTSLMTNTGCPLPTRNLLCPCSSVTGTSTRSKGMEGTTERPEPRAARGP

SEQ ID NO: 954 - protein, 64 aa, Homo sapiens
HLLPCLEKQECHLLLPLFLVVLESLHLLHFPEALAFLHLHPEWVCLHLPHLDLEFLQPQFCHLD

SEQ ID NO: 955 - protein, 45 aa, Homo sapiens
HAGACTEEIAILMRLTSPNASVLAATPENIVKWRFQKASLQEQPQ

SEQ ID NO: 956 - protein, 41 aa, Homo sapiens
WIQLDFDFRLMRKENPKLHTWCSWRSLKKKDSWHHIEGGFQ

SEQ ID NO: 957 - protein, 14 aa, Homo sapiens
IQLDFDFREWLMCC

SEQ ID NO: 958 - protein, 78 aa, Homo sapiens
ADFTEPGQAISPHPTLELSPATSNPHPLGPQIWPPGLPPSHMLPSPHLATRVSRLTCDIFPMEESWDLQLAIMDCSDF

SEQ ID NO: 959 - protein, 74 aa, Homo sapiens
RWLPGGGSPWTSRRGPPWSSTTPCTQGVREGTASGKTRGEAMGSGQATVTSMSPGPPCRGSGASSFIRHTGNPP

SEQ ID NO: 960 - protein, 49 aa, Homo sapiens
PQQRAPLVELKILARGSHSSRPGSHPRRHIQSQLSQALELGQPSTDFIL

SEQ ID NO: 961 - protein, 45 aa, Homo sapiens
VGPKKGARHRWPVPAPLLSASASTSLPSPSSCPHTLFRKNPLWRC

SEQ ID NO: 962 - protein, 56 aa, Homo sapiens
ATMTHPRTATSLDIMTCLQYGIPHHLHFDARTVEEPGWYGRGQHTWLLLLKAGDRA

SEQ ID NO: 963 - protein, 78 aa, Artificial Sequence
  modified Homo sapiens FSP
AQGSVMISSPASSQRWPPPRWMSSEVTRLWSSSGAGKSETCGSCARSISGRQSPSPAACWMAWLRHRLRAGAGCGQVP

SEQ ID NO: 964 - protein, 59 aa, Homo sapiens
NMREFILGRNRTDVMNVVRTSLEIQTWQIITESILERNRTDEMCVVRSLVIIHTLHSMR

SEQ ID NO: 965 - protein, 34 aa, Homo sapiens
LEIRQLSSKSLWRVGPKTRVLNSSKPPLSQIPLR

SEQ ID NO: 966 - protein, 24 aa, Homo sapiens
LWTIRNYLLHKLLKLFRIYNSGDF

SEQ ID NO: 967 - protein, 23 aa, Homo sapiens
SQGSQNFALTKHHWLILESICAK

SEQ ID NO: 968 - protein, 59 aa, Homo sapiens
HPTTWNACPWGQLPTGEQIRPGRHPPLRPQRPSPRPRLLTMPTGLQSRLFSAEKTPLPL

SEQ ID NO: 969 - protein, 24 aa, Homo sapiens
NSPFGSSCLQTSNNNMEKVTLKKV

SEQ ID NO: 970 - protein, 34 aa, Homo sapiens
ISFRVLASSWYASLPSPSCNLWMPSTKIRLFTAI

SEQ ID NO: 971 - protein, 27 aa, Homo sapiens
SLFLPGSTPSLHFLCWSLRSSGGCRSA

SEQ ID NO: 972 - protein, 30 aa, Homo sapiens
LESLPAFLRCHLKTEVPCGLWLRSMGEIAS

SEQ ID NO: 973 - protein, 38 aa, Homo sapiens
VGELCGGSEPQTQSWCVQLGVGMGLKKPSCWCWTLMWT

SEQ ID NO: 974 - protein, 35 aa, Homo sapiens
RRRTPTAMGRNHSCTSRSPSSSWMSSESWRSRTCR

SEQ ID NO: 975 - protein, 30 aa, Artificial Sequence
  modified Homo sapiens FSP
HWSPSPLHHHAHCLPTPEWPRAWVLQQYPH

SEQ ID NO: 976 - protein, 20 aa, Homo sapiens
HHHRRAPGQGSATASPARCT

SEQ ID NO: 977 - protein, 29 aa, Homo sapiens
WSRSWRSSRCPCCGWSTTARPACSMRLTS

SEQ ID NO: 978 - protein, 19 aa, Homo sapiens
NGNPVQESPQHQMIQDAQG

SEQ ID NO: 979 - protein, 22 aa, Homo sapiens
CPMMNFLRYYLRLKIPLGCNLT

SEQ ID NO: 980 - protein, 26 aa, Homo sapiens
LTKLMVWLQYGQAGKIRFTVLLFPPC

SEQ ID NO: 981 - protein, 20 aa, Artificial Sequence
  modified Homo sapiens FSP
ASTSSVTASCASTTSRGMWN

SEQ ID NO: 982 - protein, 27 aa, Homo sapiens
LARSSLSLEANSPYLGVWRPPLRMGLW

SEQ ID NO: 983 - protein, 27 aa, Homo sapiens
LGGGCITLAHVCQAWPVYGLHLTDLFV

SEQ ID NO: 984 - protein, 18 aa, Homo sapiens
LSRNSTLLIEENLHHSKN

SEQ ID NO: 985 - protein, 14 aa, Homo sapiens
NTGPRKNRSGKKWK

SEQ ID NO: 986 - protein, 11 aa, Homo sapiens
PPVWSRCGRRC

SEQ ID NO: 987 - protein, 15 aa, Homo sapiens
LSLPETALKQYACTV

SEQ ID NO: 988 - protein, 21 aa, Homo sapiens
QLDLLLPSEYYMFPAWGSVFW

SEQ ID NO: 989 - protein, 13 aa, Homo sapiens
SMKKIESWTSLHP

SEQ ID NO: 990 - protein, 10 aa, Homo sapiens
SLFRETQSNR

SEQ ID NO: 991 - protein, 21 aa, Homo sapiens
LTSSCGSWIAYCCCFKGKSVL

SEQ ID NO: 992 - protein, 13 aa, Homo sapiens
PFLPIQKAASGRG

SEQ ID NO: 993 - protein, 13 aa, Homo sapiens
SDAPLEALTGQGM

SEQ ID NO: 994 - protein, 10 aa, Homo sapiens
KKKKRTRIIM

SEQ ID NO: 995 - protein, 10 aa, Homo sapiens
RMKKVIIKWA

SEQ ID NO: 996 - protein, 11 aa, Homo sapiens
INEKRLTCSIL

SEQ ID NO: 997 - protein, 19 aa, Homo sapiens
ATSTPGRLSSSPRCPGNGG

SEQ ID NO: 998 - protein, 15 aa, Homo sapiens
NVGRPLDTVQPLKCI

SEQ ID NO: 999 - protein, 10 aa, Homo sapiens
DEKKREKVIS

SEQ ID NO: 1000 - protein, 11 aa, Homo sapiens
SNKKWKKMKRS

SEQ ID NO: 1001 - protein, 8 aa, Homo sapiens
TMKKIVMY

SEQ ID NO: 1002 - protein, 21 aa, Homo sapiens
GGGTQDSVWQACRKSQVPLLS

SEQ ID NO: 1003 - protein, 12 aa, Homo sapiens
FSPPPAACSPAK

SEQ ID NO: 1004 - protein, 10 aa, Homo sapiens
TVQKMQNTCV

SEQ ID NO: 1005 - protein, 11 aa, Homo sapiens
NPKKDQLLKDF

SEQ ID NO: 1006 - protein, 10 aa, Homo sapiens
RMGGSQLSRI

SEQ ID NO: 1007 - protein, 11 aa, Homo sapiens
TNKKQLMRKKS

SEQ ID NO: 1008 - protein, 11 aa, Homo sapiens
ELKKITVNYLQ

SEQ ID NO: 1009 - protein, 13 aa, Homo sapiens
FIEKNSKMTQIIQ

SEQ ID NO: 1010 - protein, 10 aa, Homo sapiens
EAKEVFPKML

SEQ ID NO: 1011 - protein, 10 aa, Homo sapiens
RVLATHPQAT

SEQ ID NO: 1012 - protein, 8 aa, Homo sapiens
AAGGTGRR

SEQ ID NO: 1013 - protein, 10 aa, Homo sapiens
AQPGSGLETC

SEQ ID NO: 1014 - protein, 13 aa, Homo sapiens
KGKKAIQRQSQMR

SEQ ID NO: 1015 - protein, 37 aa, Artificial Sequence
  modified Homo sapiens FSP
CWSPLQPRARQRQTRCQVRPPPGPPCLPLAKRSRSPR

SEQ ID NO: 1016 - protein, 34 aa, Homo sapiens
RRSCLPHQLHPWGPSCLLCLGTIVPLPCAPSSPG

SEQ ID NO: 1017 - protein, 10 aa, Homo sapiens
PGALLNPSRG

SEQ ID NO: 1018 - protein, 13 aa, Homo sapiens
CHPHHPQVPHHPL

SEQ ID NO: 1019 - protein, 11 aa, Homo sapiens
LGLNMKRNSKP

SEQ ID NO: 1020 - protein, 11 aa, Homo sapiens
EPKKSLIPLSG

SEQ ID NO: 1021 - protein, 9 aa, Homo sapiens
GWHWAFRKE

SEQ ID NO: 1022 - protein, 49 aa, Homo sapiens
GKTSTPLTSISPRWPSLLTCSWLGWHWAFRKGSPRRCWACVQAQRWCGW

SEQ ID NO: 1023 - protein, 10 aa, Homo sapiens
VNFVKILMIQ

SEQ ID NO: 1024 - protein, 38 aa, Artificial Sequence
  modified Homo sapiens FSP
GSGSAPCRRVRGPASPMGMRRRAQPSASTRRCSACSTS

SEQ ID NO: 1025 - protein, 42 aa, Homo sapiens
ALSVYQFFIPQREVKISTIILPSNKPFKPLTKRILVLLGSIK

SEQ ID NO: 1026 - protein, 34 aa, Homo sapiens
ARPARPCPTGHSLVQMEPLTTARPTSSSTTCPRT

SEQ ID NO: 1027 - protein, 18 aa, Homo sapiens
ATRMPEPHRALPTRVPFP

SEQ ID NO: 1028 - protein, 11 aa, Homo sapiens
SLVMKGQIPVR

SEQ ID NO: 1029 - protein, 10 aa, Homo sapiens
YYKYVTNACL

SEQ ID NO: 1030 - protein, 10 aa, Homo sapiens
SLPPAPLLHE

SEQ ID NO: 1031 - protein, 24 aa, Homo sapiens
ILTMRQWLKNRSLERTHLLIIQNI

SEQ ID NO: 1032 - protein, 14 aa, Homo sapiens
TPWSTTRPTTPWLT

SEQ ID NO: 1033 - protein, 11 aa, Homo sapiens
LTIKITSTFIS

SEQ ID NO: 1034 - protein, 15 aa, Homo sapiens
RRPCTHSGSTTRSHS

SEQ ID NO: 1035 - protein, 10 aa, Homo sapiens
VIEKNLMVGG

SEQ ID NO: 1036 - protein, 10 aa, Homo sapiens
TAEKRIKMST

SEQ ID NO: 1037 - protein, 55 aa, Homo sapiens
TPMDSHRSSQDKTLTHPSMETTRRRVPHPTMTTRTSLPPTGMTRASDRPSSARCS

SEQ ID NO: 1038 - protein, 42 aa, Homo sapiens
LSTVTTHWSSGWTLCWALPKRASNWTSRTSRQWAPPWTSCGS

SEQ ID NO: 1039 - protein, 39 aa, Artificial Sequence
  modified Homo sapiens FSP
LPQPCGPASCSTPSWPMAVPTSRSCMARSPRPSACQLPR

SEQ ID NO: 1040 - protein, 28 aa, Homo sapiens
VVNLGHSCCLDPETRLLRCGMSVLACAL

SEQ ID NO: 1041 - protein, 23 aa, Homo sapiens
LLHFLEKSPLEEWNQWVMHLCWH

SEQ ID NO: 1042 - protein, 26 aa, Artificial Sequence
  modified Homo sapiens FSP
RISLFLGSHPFRARILCLTPCKPRSS

SEQ ID NO: 1043 - protein, 17 aa, Homo sapiens
NLWLIVLTQLVLNLVQE

SEQ ID NO: 1044 - protein, 16 aa, Homo sapiens
PTTQHMTTSAGSLSPT

SEQ ID NO: 1045 - protein, 16 aa, Homo sapiens
LLKRTIQMPPASPASS

SEQ ID NO: 1046 - protein, 13 aa, Homo sapiens
RERFLSNRMKWKY

SEQ ID NO: 1047 - protein, 11 aa, Homo sapiens
KPIFLNRYLLQ

SEQ ID NO: 1048 - protein, 10 aa, Homo sapiens
HNPFLASCRW

SEQ ID NO: 1049 - protein, 10 aa, Homo sapiens
QCPSCMPSGT

SEQ ID NO: 1050 - protein, 9 aa, Homo sapiens
ETAPHLHLL

SEQ ID NO: 1051 - protein, 58 aa, Homo sapiens
PQWCGWVRYEGPRAEPWAKEHPLVLTLQPQAGTLYIFTDKSKNLYSLCGSTLVSLQVS

SEQ ID NO: 1052 - protein, 74 aa, Homo sapiens
CSQRRWIHLMRYATAFLCNSVDNMISQCLQFECFLKCRKLVLTPMPLLMVIIIRLFWKVPGLQEVVVAIFFGQK

SEQ ID NO: 1053 - protein, 53 aa, Artificial Sequence
  modified Homo sapiens FSP
RGAALAISMGVRVMWASFKHSTLALAVCHIISRITLGLSLQGVLSTNSSKSSS

SEQ ID NO: 1054 - protein, 84 aa, Artificial Sequence
  modified Homo sapiens FSP
RRSCPTLRACANSWSTWLSLWSHRPPPGASSGWAGPAATSSLEASGMPPSSPSMASLCWSTVAQTPSPVSGSWCGTWTAWMPCW

SEQ ID NO: 1055 - protein, 54 aa, Homo sapiens
EKSVKEIKCFLTMNLNIAKVLLKTKVYFMYLTSLSKNPKIFMHRNLKQKWHLGI

SEQ ID NO: 1056 - protein, 51 aa, Homo sapiens
RRKSWKMKSPVDTVLSKENQICKVKTILAPAPHALSLPRPQPFFRAIDKDR

SEQ ID NO: 1057 - protein, 41 aa, Homo sapiens
SRLSPPEAAFQRMLAMELRSPDHPRAEYPDFSPSPGPVAGL

SEQ ID NO: 1058 - protein, 38 aa, Homo sapiens
PRPLPGLPAPPQRSSWMGSSCSSCGTRPMSSWLCAWGE

SEQ ID NO: 1059 - protein, 15 aa, Homo sapiens
SWMGSSCSCGTRPMS

SEQ ID NO: 1060 - protein, 34 aa, Homo sapiens
NWILVNLFSGTSKAPFLCGGIDQTSQPSAGPRGT

SEQ ID NO: 1061 - protein, 28 aa, Homo sapiens
VGRSGWGVPASCTAAPPTSRWMSWQDCS

SEQ ID NO: 1062 - protein, 30 aa, Homo sapiens
SAGVLRGSKRTGPACMPTKRRTVMKSTWRS

SEQ ID NO: 1063 - protein, 25 aa, Homo sapiens
IWWIVQNSFLLPFRMSSFPKKFFFL

SEQ ID NO: 1064 - protein, 24 aa, Homo sapiens
ANSKLSSSLLLRKHSCGQKHLTSC

SEQ ID NO: 1065 - protein, 21 aa, Homo sapiens
ISSWQVLFMNIQEDILSLLSQ

SEQ ID NO: 1066 - protein, 17 aa, Homo sapiens
LEWQALDYSRSWLWTDT

SEQ ID NO: 1067 - protein, 12 aa, Homo sapiens
LLRQGKCQSAWS

SEQ ID NO: 1068 - protein, 83 aa, Homo sapiens
PRSYMPTLCAASTMPWQKTFPSNHWCRWQPGALGSMGTSCWQGTARRLSPFRWTKRKCWHCWKRCCSPTCPCQPLEDMPSQPS

SEQ ID NO: 1069 - protein, 46 aa, Homo sapiens
QLALKHQLRHPLHPPHLVPKLQRRQFLAKQGQWGPPRAREKLTSSQ

SEQ ID NO: 1070 - protein, 61 aa, Homo sapiens
HPVRPPPPNVRAWVGQQPPMPLGRPLGLEGQGARLIPPVSLKGFWDPRPTGKGLEGGRHRT

SEQ ID NO: 1071 - protein, 42 aa, Homo sapiens
ASPRRPRRALRGPVRARTPRGSSSMRSLSMTSLHSALTQSLS

SEQ ID NO: 1072 - protein, 57 aa, Homo sapiens
EAPSTRAAPPSLRAARAHQRTGRQHPPPAKHSSSQCTQGRRWGAWHPGSWPVAQRMG

SEQ ID NO: 1073 - protein, 30 aa, Homo sapiens
RPWNSSTRGCCRPVGRPRPRGGWVWWAPRA

SEQ ID NO: 1074 - protein, 25 aa, Homo sapiens
LTPVEKLRRKISELLLGNNMQPNSI

SEQ ID NO: 1075 - protein, 22 aa, Homo sapiens
LAPPDWPGIWMDSCRRPAPQDC

SEQ ID NO: 1076 - protein, 25 aa, Artificial Sequence
  modified Homo sapiens FSP
RPCSSCWGLVLPTCLLASWQPGGCR

SEQ ID NO: 1077 - protein, 24 aa, Homo sapiens
ATPVANVSAGAPTSIATSLFTIPS

SEQ ID NO: 1078 - protein, 17 aa, Homo sapiens
RPASSWCSPSRSVPSAS

SEQ ID NO: 1079 - protein, 19 aa, Homo sapiens
RSIFRGHRSWDLPIIVNLS

SEQ ID NO: 1080 - protein, 10 aa, Homo sapiens
ESEKNWWKNL

SEQ ID NO: 1081 - protein, 14 aa, Homo sapiens
DITITLELRTIWIV

SEQ ID NO: 1082 - protein, 11 aa, Homo sapiens
PQPPGCCPWPA

SEQ ID NO: 1083 - protein, 13 aa, Homo sapiens
RSFFPKSSPLFRM

SEQ ID NO: 1084 - protein, 13 aa, Homo sapiens
LLGGCSGLPWPRR

SEQ ID NO: 1085 - protein, 9 aa, Homo sapiens
RCPPRWSPC

SEQ ID NO: 1086 - protein, 8 aa, Homo sapiens
TLRFLHLS

SEQ ID NO: 1087 - protein, 83 aa, Homo sapiens
HPQVCPLRGSQLQRTEQGEDHPLHPLSRQHRALVVGELGPQAWPQLLLEPNSGKSASRRRPQGGPQPPKLRVVEAEVGDSWKR

SEQ ID NO: 1088 - protein, 1507 aa, Artificial Sequence
  Assembled poly-FSP polypeptide 1A
TEIQLTMNDSKHKLESPALKQVSPASPPTQQPQTPQDSRQVLALAKKTLTNASRAGQFPVWRRTSRGMSLQWKSGNACTPLRCPSRSPATFLTALNGWHRSGLRAQMPSSWSSSGRTLKLAPLQVTTTLKLILVMLEIVTERSLLYSRMCLVQIPTHTWEPDYFVSLPMMFSWATQSFPVGAVFLTRPAIPCCSCTSHSNPWSQSNQQLKWTPHILKSASFDKKGFVILSRRSKIEASPIGSIASSPGHPLGPTLAIRFISAPQPSSSTVTAAPSGQYFIAKKRIKLRRNNMGGNRSICLTRKRKREKRSQKSRQNHLQLKSCRRKISNWSKLRSPWIFTKCEICVKNTAILAITLITPQDPHLDPVCHPHRRPGWKGHHRVVFSHHPSGSTKSHWQQRERGGGRREKKGCREQRKVVKNPSQPVPLRNDGITNGNDSTRSCSISLKKSLEKMPLMRRARPTSCSTCRMWWKGKKRRKEIVPMSLACSITVSFVGQISTLVLDVSSISHWRLPCKVTESSSSFFYTSDRTPLSISRPTSRARQSCCLPGLTHPAHQPLGSMSTRREMPSQATPSPPGPWRAALGKEVKRSQSKLRLRNTSPGEKNDLQLFVMSDTTYKIYWTVILLNPCGNLHLKTTSLQRPPRSILSLNGIWEVMPRTLEGCISVKDHRTSQNHSKCITECVRTALNVSKKRLPKLMKKKDSTIFINKVRQNFKRNFKKKKPLTFSPSRRMTRRTMTTTKMMMMRRTKRRRRKRRRMTMMTRRTLLTKKTCLTPRTSAATKALPRQTISQRRPIQTPPGTSLAIWGRTRLTLTGTRSSGTRASPSAVCLCCWTCPSRSFPAASPSGLRAPVGAQAPPEVTLRASCASSASKACAGLWPWGAQVRVGAGTGGGPACVPVAEASTGAWTAEGAAGTRCRASRAPCRQLPASSPTKCEICVKRRRRRKRSSQSRSPVPKKRERMMLPVRARTARSALPQGRAPLEGMLLPRALPSLLSRMPARRESRFWLALQALGLRPPHLPSCHPLPQLLGPPPPHQAPMTLKALVKTWTQFRNYPRADKKNVRSTAFFLLDIILGDCPRTMAGPSASLHPASGRASRKTWQRRLRACRAGGPAGWARQAYPRLKTFGVPLGSILCLAGSLSTMMIISTTRQECGRRASVPCRPMIGSARPGPWRTSAMPSAMGVALPTSCESGRSPPATGGRMPGSQSIMMSWMPPLAPCAACPCSPAPTLCPAHPARAPTAVPAFTPLSAHPVPVLSGCHLAVRTSMLTLLPMEAKKSMKRSNAKKMEDMIWESRLPLRPQRGPRPLHRWLQQTTGCSQRRIVFFLAPYFPRHPHRSPPTSCPPLLEAFPLPRASLRATVPRHSSVLATGLHLHRQISLPLRGFLLHQPLPGQHLWLSHRLRLRLPRTQPSLPGPCASLLSTLSQPPPQAPSQVWTAATLRCPAVPAAACPPALRSMPKSRNQVLFRRNLTPSQLRTLAPPYMLLPQSLSQSLSRKQIPSQSMLV

SEQ ID NO: 1089 - protein, 1501 aa, Artificial Sequence
  Assembled poly-FSP polypeptide 2A
RKMQSLNHPSRLTNGSPPLHLCQPLRMSRTPPRRVCAAPPHRLLGPSRWNPRRKTWKMRKKYAQKPSQKNHLYGGKKRSKFSRSHLDFSPYWMKKVKVLFKADQSESSLSSGRCSLMEQIPHLKSRRKWQIRHVLKNLWLPMRSLGEPWRAGFQWGESPWQVMASLTGRATFLLALWECSLPQARLCLIVSRTLLLVQSRNKKTKLWFSLINIHHRKNPLLPMRWWCTRGGGKRKKKMCKVSGGCTACVERCPWKGICWKWPVTVAAIRMCALSHPSFYISSTVCFLSKHCMTACTRKRMKTGAIQEKGAIQEKGAMTKRICVVNFEACREMESLSAPEKITLFEAHMARCTSINVLCVRASLIEKLMKEKRKMKRNQVASPQIMQRLFIKGYQNNHFTFHLQNFAFFSSFGNNKYINILTILFHVRNIVYGIQVMLCASPQIMQRTSADRFRMKRRMQNLDNLGVPWPLLPGIPSLNAQWMFLRIASPQIMQRMSAVNFETIRARNRNMKKTMSHLIAHQALKMSGLRLFHPRLLTRKKPGKLLLAHMYGFSTYGTQKGECVCLQCLSGSSLFILKQPLDLKISKTFMGHREGSESDNLGLLYSFPPPYPISEGLTMTTGRNINSNSLMTNCLFSPIFLCHHAIMHRKMTSPHFRLFSSKIPHPQVPSVVALCKFRAFIHTPRSPGCSVYANMCWPKFFLTFSQQWSSVTSLEWTAQERGCSSWLMKQTWMKSWSLRDPSYRSILEYVSTRVLWMPTSTVLQAHPQVPALAPQAWWPARRGPLTSAPSAQQSLTREKIINPTISCPFQSPTKRLIYPPSTCSLPCRGFLPSRFPWGPPPLNSVIVHKIVLVFLKSLSSYNCERRISGIQKRAIEFAVLKLLNMDLPLENTQIPRTSPLWKITMVLTYPNCVVHVLMFGALRATAPATAAPQAQTPHWRAATTSSMSSSPRAEPTSSSSWATCWPRCCSSSCYWSLSSWPPAGAAEATNTRTRSRESQRGRMLTWRSSLWLQGTRCFTGVRTSSRYKKRGVIAWRRQINRRKLQRKKHWNSAYLGRTLLVTCILYHRWIVTSMCQSQRWLTSTTSRSSALMWTELSLEPWIPYLHQQKTQRTLESAGLFPWLHTQCQEKKSRKLMSSCTHPCTMLLPQGCHPAWLSPISACPRLLPYPFHVLALEVTFPPGTAMPQMQLQALAMWEKGWDKPGTSLQCYLNRRRNSRKQSQVQLAIQVLLVDKHKYFLFGQKKGHMIFSLANGLWFNLIFNSRKKLLEDMKQNGFTGKGLTHPVPLKRTLQNKRNKNIKRVNQKKGNIKRKSILLHLIVLNSPESNLILIQHGGIFTFRFWVEKLSWNICKNLSLYLDKFVQRLLYVYIIETNVFVLNLFHVPVNQIFMMAFYLKYTEKAWVMELEWLIQQQCYQGSCGRACSCGRGCGTPRGDWKRHPPRRAFWKPPSQGISSCLMTGCWLEKKATWMRRTRRKKREDHCGLRHPSWPWTRCLRMRPPRS

SEQ ID NO: 1090 - protein, 1506 aa, Artificial Sequence
  Assembled poly-FSP polypeptide 3A
GAAAASCQSPPSPRETTPSSDATRRTRPIAAQSKKTMTAAGLTPMIRKIQKRRRTANRCLRVRCGGWLCGWTPRGQNTRSTNLEKNPSLKKQSQRRGKLSSLFFSHCLCRNSRRATPTSKGSLRRKYLRVPIPPHLRHPLLLMDLDGMLTVIGQGLVGMTPRDLGTVAGATAQIQRPIQVQTGGRLTPPPLILWPQAAPVDPPGSVWILPCKNKKRRKLRPKRLDFHPRSSSGVSVITMKLWEKHFKGLNWNLVVWILNLKMMNIEITPQRSKARKSGVMKCWDLCPSEKKRKLPLPLTFSTLLWDSRHRGASSSTSRDSRSFFTSAHPSRPCRMRLYQFLIHLRKVDTHHLQVVTKTVTATTADGQRMRRLKCKACRLRWARPEPAAQAPPKSHFPPHPSGPSRTSSLQLRSIPHVPKATAAHSVTVKLQKGKNSPCCQKKLRVQNQGHLLMILLHNTYMEMHYGHQAPQVAMLPKLLCRQMLPTLSTLQQRHPQGPCPPPVTPLRVQSVLLLGVPQTAARQPSRPTGRTPTTRLMAPVGSVMSCSLLTQPSPASACTMPPLLHPQWAPHSAGLSPGACRPACTCISMTTISRATWQVSVYSGNLLSFSRRGMKSSVRLKNSRRNRRYRKIYGELKMSLQAVAPRCPRSAVDISPGPTSPSLASCASVAIGKLALLGASAPCGAAGAREAGRFAVLGTMVMKHLNRKLHLTRSCLIDLTMMMSQKLWKNQRKRIPLPSPRQHLLPQYPLHPPPPCLLLLHHRHHLAFLEMACSSQHTHSIKIWISFSHEQSSPFLARSWNTMQWNNKKMAMTVIAGAHHCQYKLTYTKVWKMNWKKMMIGSQHLLFSPLDSSPLQLLLHPHGKRCNPCCRLTWMSMLQKQCCYNLVIKHPLIFRINLRRQGKTKDGVVQSLGFLNQQIILQKEFFICLLMFIKRWKPAATKREWEKRKQILGGGGKYKEYFLKRILIRKAMTVLAGDKKGLGRFMRCVQSETKAVSLQLPLGRGPVYYVCNRMNVSSVLKPFLFTVPIEDMRECTLGRNRMNVSSVLKPCLIPVPIDLPRMLPISSPLHRPQMPFWTCTFPATTWGTWETPSTWGWRTFRGPRRKVLMVLWLPANQSLQKSQVFQWVLRTENIRKLIWTKQRSFLSLFPKLRATEQMTNVGCAFSGRILHQPEMAAMRLMPKFLNSTNSWWTCTNLSVPMMLTILIWKRVFILLLSDKKLLKKSSQLRRSWRNVSRISHQMKCLTAVDCLQAFWDMNMEHRLTMDSALSLTKREGPETCKKKLLLKLLTMSLSNILMKFRLRLRIPSLRKYRQHLKKTSAKGEKLKHCFKAWGRGPPLHTRSQKKDPAGKLKKLTTLSFVLIEERRNLQRNLKVLWLKKSTKSRYLFFLTVCGFFEKKRPEWLSSRKKGHTKNRRKAKRKPQIVHKKRGLFLKKKYLVQGAKKITFLSNGMEACGTHPTPRLSDRVFLVKITTTTSSPRRSPALRARGGTTIGEVTSLCFFYLLY

SEQ ID NO: 1091 - protein, 1507 aa, Artificial Sequence
  Assembled poly-FSP polypeptide 4A
IQKKKQKSMAKKSQQPLVLKKNRKQEWGGQAHRQRNNAKKMPFQEEKKNGRISSSLILSFQRVKDSKKMTQKMCSSLALPTGLTSLILPSSDLAVLISSSTSHFLMRSPVLPSSRLTCASPQLPRMWTWSSWLKHPRTASITLPTTSLKGSRTSCCPRSHPRLPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRRSQKSQHHCALRKIEWATKLSLGGKAGPQAQEKARPSPCLSWSSRIVAPGHALSCRTRRRWSSKCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIFCQKKVPSASPWGLVPPSPPLALGPRMQLCTQLARFFPITPPVWHILGPQRHTPQVVLRLGNLPPFFRGSEVPFPRPCRTKNEGNNHWPRVEMPTGWLLVGYNTRNTAQNPRLQQHLKHWQQCTRARWCQEPCQTLTFFHFFFFFKTVSLCCPGWSKGQPPPPGLKPSSLASQVARTTGVYQHVWLICFVFFVCVETGFCHVAQVGLERLVSLSGITDVNHWAQPKPSPSKGTGMNRPIGLRVGKGVWARLLKKKPRDICRISNRKTRKAAREKHRKTDRASVSFWTLLPTTGVRTRGSPLRLTLWPPRCRCRREYRVTMNILNSLPSSMEIAVLQETAKKSPTSFCCNLDLQHQRRRKKKKDKVEIRNRSPKANSTECQGEHSREQNLLNLVQLNPHSPHHRKDEEDHQKRHHHHNQKKMSVPLFFHGDLCRESTLGNFWMKLLQLPQRPPLQPVTGMEILLWILLKMEIQIFKICLGEMQLCTSRILNLQVLKKILRSFMKLYHSLVMCLRLRTKLEKALSALFIWPQHSYKITHPFASQPLGQEMPNNTQIRLLKPDKKKKSTEKTKGQAFGSFSADFSAPQGQAFGSLCQLVSADFSAPQVTRLRSLNHLLIWLKNWKRFKLKKKYQAPLRLWSWCGTSQTYFGSIICIKNMFLQRKGFLNLSHVEKFELKKNLLLPVVINLKRLQKFMLNQKCLAPFPACTSKAWTPRKLVGRAVRRKGILAMTLTLNGIEALTALFTCRTASISVNISTLMSILEAIIKKMKKRIMVHRWIFSNQLTVQMLCLPLLTPDTRWIFSNQLQTVQMLCLPPLKQGERIIWPLGGFQIPNFFWSLGIGHTGAWWHTGRRRREWGGSTVSRSPLWISSMIYLRGMAFASDSSIRTTRVSWCRRCGAKSAAASSSPLWDCSTTTGTHHGCLWEIPSVTLLANLHLCYYHSQSNRNKSRQMESLGMKLQLKKKVNACSTYTPHICRHTCRVNAVEELHSRRMSVRIVKNWVSCCYVRLSAVGLSTWSALDNKIICKGHRIT

SEQ ID NO: 1092 - protein, 1507 aa, Artificial Sequence
  Assembled poly-FSP polypeptide 1B
TEIQLTMNDSKHKLESPALKQVSPASPPTQQPQTPQDSRQVLAMPSSWSSSGRTQRKVVKNPSQPVPLRNDGITNGNDSTRSCSISLKKSLEKMPLMMKKKDSTIFIVPMSLACSITVSFVGQISTLVLDVSSISHWNKVRQNFKRNADKKNVRSGEKNDLQLFVMSDTTYKIYWTVILLNPCGNLHLKTTSLGDCPRTMAGPSASLHPASGRASRKTWQRRLRACRAGGPAGWARQAFDKKGFVILSVGAGTGGGPACVPVAEASTGAWTAEGAAGTRCRASRAPCRQLPASSPTKCEICVKRRRRRKRSSQSRSPVPKKRERMMLPVRARTARSALPQGRAPLEGMLLPRALPSLLSRMPARRESRFWLALQALGLRPPHLPSCHPLPQLLGPPPPHQAPTAFFLLDIILRLPCKVTESSNMGGNRSICLTNAKKMEDMIWESTPLSISRPTSRARQSCCLPGLTHPAHQPLGSMTLAIRFISAPQPSSSTVTAAPSGQYFKGKKRRKEIFKKKKPLTFSPSLAKKTLTNSSFFYTSDREAKKSMKRSMTLKALVKTWTQFRNYPRASSPGHPLGPNGIWEVMPRTLEGCISVKDHRTSQNHSKCITECVRTALNRRSKIEASPIGSIALRSMPKSRNQVLFRRNLTPSQLRTLAPPYMLLPQSLSQSLSRKQIPSQSMLVASRAGQFPVWRRTSRGMSLQWKSGNACTPLRCPSRSPATFLTALNGWHRSGLRAQRKRKREKRSQKSRQNHLQLKSCRRKISNWSKLRSPWIFVSKKRLPKLTKCEICVKNTAILAITLITPQDPHLDPVCHPHRRPGWKGHHRVVFSHHPSGSTKSHWQQRERGGGRREKKGCRERSLLYSRMCLVQIPTHTWEPDYFVSLPMMFSWATQSFPVGAVFLTRPAIPCCSCTSHSNPWSQSRHPHRSPPTSCPPLLEAFPLPRASLRATVPRHSSVLATGLHLHRQISLPLRGFLLHQPLPGQHLWLSHRLRLRLPRTQRPPRSILSLRLPLRPQRGPRPLHRWLQQTTGCSQRRYPRLKTFGVPLGSILCLAGSLSTMMIISTTRQECGRRASVPCRPMIGSARPGPWRTSAMPSAMGVALPTSCESGRSPPATGGRMPGSQSIMMSWMPPLAPCAACPCSPAPTLCPAHPARAPTAVPAFTPLSAHPVPVLSGCHLAVRTSMLTLLPMLKLAPLQVTTTLKLILVMLEIVTESTRREMPSQATPSPPGPWRAALGKEVKRSQSKLRLRNTSPIVFFLAPYFPRRMTRRTMTTTKMMMMRRTKRRRRKRRRMTMMTRRTLLTKKTCLTPRTSAATKALPRQTISQRRPIQTPPGTSLAIWGNQQLKWTPHILKSASRRARPTSCSTCRMWWIAKKRIKLRRNRTRLTLTGTRSSGTRASPSAVCLCCWTCPSRSFPAASPSGLRAPVGAQAPPEVTLRASCASSASKACAGLWPWGAQVRQPSLPGPCASLLSTLSQPPPQAPSQVWTAATLRCPAVPAAACPP

SEQ ID NO: 1093 - protein, 1501 aa, Artificial Sequence
  Assembled poly-FSP polypeptide 2B
RKMQSLNHPSRLTNMSRTPPRRVCNPRRKTWKMRKKYAQKPSQKNHLYNSRKKLLEDMKQNGFTGHREGSESDNLGLLYSFPPIRMCALSHPSFYISSTVCFLSKHCMTACTQKKGHMIFSREKIINPTISCPFQSPTKRLELSLEPWIPYLHQQKTQGGKKRSKFPGTSLQCYLNRCSLMEQIPHLKSASPQIMQRTSADRFRMKRRMQNLDNLGVPWPLLPGPLENTQIPRTSPLWKITMVLTYPNCVVHVLMFWLPMRSLGEPWRAGFQWGESPWQVMASLTGPYPISEGLTMTTGRNINSNSLMTNCLFSPIFLCHHAIMHRKMTSPHFRLFSSKIPHPQVPSVVALCKFRATFLLALWECSLPQARLCLIVSRTLLLVQSAAPPHRLLGPSRWSRSHLDFSPYWMKKVKLANGLWFNLIFVLFKADQSESSLSSGRNKKTKLWFSLINIHHRKNPLLPMRIPSLNAQWMFLRILLLAHMYGFSTYGTQKGECVCLQCLSGSSLFILKQPLDLKISKTFMLQAHPQVPALAPQAWWPARRGPLTSAPSAQQSLTASPQIMQRMSAVNFETIIYPPSTCSLPCRGRTLESAGLFPWLHTQCTHPCTMLLPQGWWCTRGGGKRKKKMCKVSGGCTACVERCPWKGICWKWPVTVAAQWSSVTSLEWTAQERGCSSWLMKQTWMKSWSLRDPSYRSILEYVSTRVLWMPTSTVRRRNSRKQSQVQLAIQVLLVDKHKYFLFGRARNRNMKKTMSHLIAHQALKMSGLRLFHPRLLTRKKPGKFLPSRFPWGPPPLCHPAWLSPISACPRLLPYPFHVLALEVTFPPGTAMPQMQLQALAMWEKGWDKRKRMKTGAIQEKGAIQEKGAMTKRICVVNFEACREMESLSAPEKITLFEAHMARCTSINVLCVRASLIEKLMKEKRKMKRNQVASPQIMQRLFIKGYQNNHFTFHLQNFAFFSSFGNNKYINILTRRKKREDHCGLLILIQHGGIFTFRFWVEKLSWNICKNLSLYLDKFVQRLLYVYIIETNVFVLNLFHVPVNQIFMMAFYLKYTEKAWVMELEWLIQQQCYQQEKKSRKLMSSCRAFIHTPRSPGCSVYANMCWAFWKPPSQGISSCLMTGCWGSPPLHLCQPLRRYKKRGVIAWRRRKWQIRHVLKNLILFHVRNIVYGIQVMLCGKGLTHPVPLKRTLQNKRNKNIKRVNQKKGNIKRKSILLHLIVLNSPESNPKFFLTFSQLEKKATWMRRTGALRATAPATAAPQAQTPHWRAATTSSMSSSPRAEPTSSSSWATCWPRCCSSSCYWSLSSWPPAGAAEATNTRTRSRESQRGRMLTWRSSLWLQGTRCFTGVRTSSGSCGRACSCGRGCGTPRGDWKRHPPRRNSVIVHKIVLVFLKSLSSYNCERRISGIQKRAIEFAVLKLLNMDLHWNSAYLGRTLLVTCILYHRWIVTSMCQSQRWLTSTTSRSSALMWTRQINRRKLQRKKRHPSWPWTRCLRMRPPRS

SEQ ID NO: 1094 - protein, 1506 aa, Artificial Sequence
  Assembled poly-FSP polypeptide 3B
GAAAASCQSPPSPRETTPSSDATRRTRPIAAQSKKTMTAAGLTPKNKKRRKLRPKMIRKIQKRRRTANRRNSRRATPTSKGSLRRKYLRVRGPPLHTRNIRKLIWTKQRSFLSLFPKLRATEQMTNVGCSIPHVPKATAAHSVTVKLQLPLTFSTLLWDSRHTMSLSNILMKFRLQSSPFLARSWNTMQWNNKKMAMTVIAGAHHCQYKLTYTKVWKMNWKKMMIGSQHLLFSPLDSSPLQLLLHPHGKRCNPCCRLTWMSQNTRSTNLEKNPSLKKQSQRRGKLSAFSGRILHQPEMAAMRLMPKFLNSTNSWWTLTTLSFVLIEEARQPSRPTGRTPTTRLMAPVGSVMSCSLLTQPSPASACTMPPLLHPQWAPHSAGLSPGACRPACTCISMTTISRATWGPVYYVCNRMNVSSVLKPFLFTVPIEDMRECTLGRNRMNVSSVLKPCLIPVPISEKKRKLPNIEITPQRSKAMLQKQCCYNLVIKHPLIFRINLRRQGKTKDGVVQSLGFLNQQIILQKEFFICLLMFIKRWKPAATKSRKKGHTKNRRKAKRKPQIYLFFLTVCGFHLKKTSAKWLKKSTKSRSNGMEACGTHPTPRLSCLRVRCGGWLCGWTPRGRKSGVMKCWDLCPVHKKRGLFRLDFHPRSSSGKGKNSPCCQKKLRVQNQGHLLMILLHNDRVFLVKIGEKLKHCFKAWGSRRNRRYRKIYGELKMSLQAFLIHLRKVDTHHLQVVTKTVTATTADGQRMRRLKCKACRLRWARPEPAAQAPPKSHFPPHPSGPSRTSSLQLRSLFFSHCLCSQKKDPAGKLKKLLKKSSQLRRSWRNVSRISTPPPLILWPQAAPVSVITMKLWEKHFKGLNWNLVVWILNLKMMTYMEMHYGHQAPQVAMLPKLLCRQMLPTLSTLQQRHPQGPCPPPVTPLRVQSVLLLGVPQTARGPRRKVLMVLWLPANQSLQKSQVFQWVLRTEVAPRCPRSAVDISPGPTSPSLASCASVAIGKLALLGASAPCGAAGAREAGRFAVLGTMVMKLCFFYLLYRLRIPSLRKYRQHLNRKLHLTRSCLIDLTMMMSQKLWKNQRKRIPLPSPRQHLLPQYPLHPPPPCLLLLHHRHHLAFLEMACSSQHTHSIKIWISFSHEVDPPGSVWILPCDLPRMLPISSPLHRPQMPFWTCTFPATTWGTWETPSTWGWRTFRGASSSTSRDSRSFFTSAHPSRPCRMRLYQCKKKLLLKLLTTTTSSPRRSPALRARGGTTIGEVTSCTNLSVPMMLTILIWKRVFILLLSDKKGAKKITFLPIPPHLRHPLLLFEKKRPEWLSMDLDGMLTVIGQGLVGMTPRDLGTVAGATAQIQRPIQVQTGGRLRRNLQRNLKVLQVSVYSGNLLSFSRRGMKSSVRLKNREWEKRKQILGGGGKYKEYFLKRILIRKAMTVLAGDKKGLGRFMRCVQSETKAVSLQLPLGRNMEHRLTMDSALSLTKREGPETLKKKYLVQHQMKCLTAVDCLQAFWDM

SEQ ID NO: 1095 - protein, 1507 aa, Artificial Sequence
  Assembled poly-FSP polypeptide 4B
IQKKKQKSNLDLQHQRRRKKKKDKVEIRNRSPKANSTECQGEHSREQNLLNLVQLNPHSPHHRKDEEDHQKRHHHHNQKKMSVMAKKSQQPLGQAFGSLCQLVSADFSAPQVTRLRSLNHLLINEGNNHWPRVEMPTGWLLVGYNTRNTAQNPRLQQHLKHWQQCTRARWCQEPCQTLTFFHFFFFFKTVSLCCPGWSKGQPPPPGLKPSSLASQVARTTGVYQHVWLICFVFFVCVETGFCHVAQVGLERLVSLSGITDVNHWAQPKPSPSKGTGMNRPIGLRVGKGVWARLRASVSFWTLLPTTGVRTRGSPLRLTLWPPRNILNSLPSSMEIAVLQENRKTRKAAREKHRKTDNLHLCYYHSQSNRNKSRQMESLGMKLQSPLWDCSTTTGTHHGCLWEIPSVTLLACRVNAVEELHSRRMSVRIVKNWVSCCYVRLSAVGLSTWSALDVVINLKRLQKFSQKSQHHCALRKIEWATKLSLGGKAGPQAQEKANAKKMPFQRWIFSNQLTVQMLCLPIEALTALFTCRTASISVNISTLMSILEAPLFFHGDLCEEKKNGRISSQAPLRLWSWCGTSQTYFGSTAKKSPTSFCCEWGGQAHRQRNTGMEILLWILLKMEIQIFKICLGEMQLCTYTPHICRHTCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIFTSRILNLQVLKKILRSFMKLYHSLVMCLRLRTKLEKALSALFIWPQHSYKQRPPLQPVQVVLRLGNLPPFFRGSEVPFPRPCRTKMLNQKCLAPFITHPFASQPLGQEMPNNTQIRLLKPLLTPDTRWIFSNQLQTVQMLCLPPLKQGERIIWPLGGFQIPNFFWSLGIGHTGAWWHTGRRRREWGGSTVSRSPLWISSMIYLRGMAFASDSSIRTTRVSWCRRCGAKSAAASSLKKKPRDICRISDSKKMTQKRESTLGNFWMKLLQLPDKKKKSTEKTKIIKKMKKRIMVHMCSSLALPTGLTSLILPSSDLAVLISSSTSHFLMRSPVLPSSRLTCASPQLPRMWTWSSWLKWLKNWKRFKLKKKYILAMTLTLNGHPRTASITLPTTSLKGSRTSCCPRSHPRLPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRRELKKNLLLPCRCRREYRVTMGQAFGSFSADFSAPQVLKKNRKQNKIICKGHRITSLILSFQRVKLKKKVNACSPACTSKAWTPRKLVGRAVRRKGIICIKNMFLQRKGFLNLSHVEKFVPPSPPLALGPRMQLCTQLARFFPITPPVWHILGPQRHTPCQKKVPSASPWGLRPSPCLSWSSRIVAPGHALSCRTRRRWSSK

SEQ ID NO: 1096 - DNA, 4521 bp, Artificial Sequence
  polynucleotide 1A
accgagatccagctgaccatgaacgacagcaagcacaagctggaaagccccgctctgaaacaggtgtcaccagcctctccacctactcagcagcctcagacacctcaggattctagacaggtgctggccctggccaagaaaaccctgacaaatgcctccagagccggacagtttcctgtgtggcggagaacaagcagaggcatgagcctgcagtggaagtccggcaatgcctgcacacctctgagatgccctagcagaagccctgccacattcctgacagccctgaatggctggcacagatctggcctgagagcccagatgcctagctcttggtctagcagcggcagaacactgaagctggcccctctgcaagtgaccaccactctgaagctgatcctggtcatgctggaaatcgtgaccgagcgctccctgctgtactccagaatgtgtctggtgcagatccccacacacacctgggagcccgattacttcgtgtccctgcctatgatgttcagctgggccacacagtcttttcccgtgggcgccgtgtttctgaccagacctgccattccttgctgcagctgtaccagccacagcaacccttggagccagagcaatcagcagctgaagtggacccctcacatcctgaagtccgccagcttcgacaagaaaggcttcgtgatcctgagccggcggagcaagattgaggcctctcctatcggctctatcgccagctctcctggacatcctctgggacctacactggccatcagattcatcagcgcccctcagcctagcagctctacagtgacagctgcccctagcggccagtactttatcgccaagaagcggatcaagctgcggcggaacaatatgggcggcaacagatccatctgcctgaccagaaagcgcaagagagagaagcggagccagaagtccaggcagaaccatctgcagctgaaaagctgcagacggaagatcagcaactggtccaagctgagaagcccctggatcttcaccaagtgcgagatctgcgtgaagaacaccgccatcctggctatcaccctgatcacccctcaggaccctcatctggaccctgtgtgtcaccctcatagaaggcctggatggaagggccaccatagagtggtgttctctcaccatcctagcggcagcacaaagagccactggcagcaaagagaacgcggaggcggcagacgcgagaagaagggatgtagagaacagcggaaggtggtcaagaacccctctcagcccgtgcctctgagaaacgatggcatcaccaacggcaacgactccaccagaagctgctccatcagcctgaagaaaagcctggaaaagatgcccctgatgcggagagccagacctaccagctgtagcacctgtagaatgtggtggaagggcaagaaacggcggaaagaaatcgtgcctatgagcctggcctgcagcatcaccgtgtcttttgtgggacagatcagcaccctggtgctggatgtgtctagcatcagccattggcggctgccctgtaaagtgaccgagagcagctccagcttcttctacaccagcgacaggacccctctgagcatcagcagaccaaccagcagagctagacagagctgttgtctgcccggactgacacaccctgctcaccaacctctgggcagcatgagcactagaagagagatgccaagccaggccacaccttctccacctggaccttggagagccgctctgggcaaagaagtgaagagatcccagagcaagctgcgcctgagaaacacaagccctggggagaagaacgatctccagctgttcgtgatgagcgacaccacctacaagatctactggacagtgatcctgctgaacccctgcggcaacctgcacctgaaaacaacatcactgcagcggccacctcggagcatcctgtctctgaatggaatctgggaagtgatgccccggacactggaaggctgcatcagcgtgaaggatcacagaaccagccagaaccacagcaagtgcatcaccgaatgtgtgcggactgccctgaacgtgtccaagaagagactgcctaagctgatgaagaagaaggacagcaccatcttcatcaacaaagtgcgccagaacttcaagcgcaacttcaagaagaagaaacccctcactttcagccccagcagacggatgactcggagaaccatgacaaccaccaaaatgatgatgatgcggcggaccaagcggagaaggcgcaaaaggcggagaatgaccatgatgaccagacggaccctgctgacaaagaaaacctgtctgacccctagaaccagcgccgccacaaaagctctgcctagacagaccatcagccagcggaggcctattcagaccccacctggaacatctctggccatctggggcagaacaagactgaccctgacaggcaccagatccagcggaacaagagcctctccttccgccgtgtgcctgtgttgttggacctgtccaagcagaagcttcccagccgcttctcctagtggactgagagcacctgttggagcccaggctcctcctgaagtgacactgagagcctcttgtgcctctagcgcctctaaagcctgtgctggactttggccttggggagcccaagttcgagttggagctggaacaggcggaggacctgcttgtgttcctgtggctgaagcttctacaggcgcatggacagctgaaggcgccgctggaacaagatgtagagcctctagagccccttgccgccaacttcctgctagctcccctaccaagtgtgaaatttgtgtgaagcgcagacggcggagaaagagaagcagccagtctagaagccccgtgcctaaaaagcgcgagaggatgatgctgcctgtgcgggccagaacagctagatctgcacttcctcagggcagagcacctctggaagggatgctgcttcctagagcactgcctagcctgctgagcagaatgcctgccagaagagagtcccggttttggctggctctgcaggcacttggactcagacctccacatctgcctagctgtcatcctctgcctcaactgttgggccctccacctcctcatcaggccccaatgacactgaaggccctggttaagacctggacacagttccgcaactaccccagagccgacaagaagaatgtccggtctaccgccttcttcctgctggacatcatcctgggcgattgcccaagaacaatggccggaccttctgcctctctgcatcctgcatctggcagagcctccagaaagacctggcagagaaggctgagagcttgtagagcaggcggacctgctggatgggctagacaggcctatcctagactgaaaaccttcggcgtgcccctgggctctattctgtgtctggccggcagcctgtccacaatgatgatcattagcaccaccagacaagagtgcggcaggcgggcttctgtgccttgtagacctatgatcggaagcgccagaccaggaccttggcggacatctgctatgcctagtgccatgggagtcgccctgcctacctcttgtgaaagcggaagatctcctcctgccaccggcggaagaatgccaggatctcagtctatcatgatgagctggatgcctccactggctccatgtgccgcttgtccatgttctcccgctcctacactgtgcccagcacatcctgctagagcaccaacagccgtgcctgcctttacacctctgtctgctcatcctgtgccagtgctgtctggatgtcacctggccgtcagaacctccatgctgacactgctgcccatggaagccaaaaagagcatgaagcggtccaacgctaagaaaatggaagatatgatctgggagagccggctgccactgaggccacaaagaggacctagacctctgcacagatggctgcagcagacaaccggctgtagccagaggcggatcgtgttctttctggccccatacttccctcggcaccctcacagatctccaccaacatcttgcccacctctgctggaagctttcccactgccaagagcttctctgagggccacagtgccaagacatagctctgttctcgccaccggtctgcacctccacagacagatttctctgcccctgagaggattcctcctgcaccaaccactgccaggacagcatctgtggctgtctcacagactgaggctgagactgcccaggacacagccatctttgcctggaccatgtgcaagcctgctgtccacactgtctcagccaccacctcaggctccatctcaagtgtggactgccgctacactgagatgtcctgctgttcctgcagctgcctgtcctcctgctctgagatccatgcctaagagccggaaccaggtgctgttcagacggaatctgaccccaagccagctgagaacactggccccaccttatatgctgctgccccagtctctgtcccagagcctgagtagaaagcagatccctagccagtccatgctcgtg

SEQ ID NO: 1097 - DNA, 4503 bp, Artificial Sequence
  polynucleotide 2A
agaaagatgcagagcctgaatcaccccagcagactgaccaatggctctcctccactgcacctgtgccagcctctgagaatgagcagaacccctcctagaagagtgtgcgccgctcctccacatagactgctgggcccttccagatggaaccctcggagaaagacctggaagatgcggaagaagtacgcccagaagcctagccagaagaaccacctgtacggcggcaagaagcgctctaagttcagcagaagccacctggacttcagcccctactggatgaagaaagtgaaggtgctgttcaaggccgaccagagcgagtctagcctgagcagcggaagatgcagcctgatggaacagatccctcacctgaagtctcggcggaagtggcagatcagacacgtgctgaagaacctgtggctgcccatgagaagcctgggagaaccttggagagccggctttcagtggggagagtctccttggcaagtgatggcctctctgaccggcagagccacatttctgctggccctttgggaatgtagcctgcctcaggcaagactgtgcctgatcgtgtctagaaccctgctgctggtgcagagccggaacaagaaaacaaagctgtggttcagcctgatcaacatccaccaccggaagaacccactgctgcctatgagatggtggtgtaccagaggcggcggaaagcggaaaaagaaaatgtgcaaggtgtccggcggctgcaccgcctgtgttgagagatgtccttggaagggcatctgctggaagtggcctgtgacagtggccgccattagaatgtgtgccctgtctcaccctagcttctacatcagcagcaccgtgtgctttctgagcaagcactgcatgaccgcctgcaccagaaagagaatgaagaccggcgccatccaagagaagggcgctattcaagagaaaggggccatgaccaagcggatctgcgtggtcaatttcgaggcctgcagagagatggaaagcctgagcgcccctgagaagatcaccctgtttgaagcccacatggcccggtgcacctccatcaatgtgctgtgtgtgcgggccagcctgattgagaagctgatgaaagaaaagcgcaagatgaagcggaaccaggtggcctctccacagatcatgcagcggctgttcatcaagggctaccagaacaaccacttcaccttccatctgcaaaacttcgccttcttcagctccttcggcaacaacaagtacatcaatatcctgaccatcctgttccacgtgcggaacatcgtgtacggcatccaagtgatgctgtgcgctagccctcagattatgcagagaaccagcgccgaccggttccggatgaagagaagaatgcagaatctggacaacctgggcgtgccatggcctctgttgcctggaatcccatctctgaacgcccagtggatgttcctgagaatcgcatccccgcaaatcatgcagaggatgagcgccgtgaacttcgagacaatccgggccagaaaccggaacatgaagaaaaccatgagccacctgatcgcccatcaggccctgaagatgagcggcctgagactgtttcaccccagactgctgacacggaagaagcccggaaaactgctgctcgcccatatgtacggcttcagcacctacggcacccagaaaggcgagtgcgtttgtctgcagtgtctgagcggcagcagcctgttcattctgaagcagcccctggacctgaagatcagcaagaccttcatgggccacagagagggcagcgagtctgataatctgggcctgctgtatagcttccctccaccttatcctatcagcgagggcctgaccatgaccaccggcagaaacatcaacagcaactccctgatgaccaactgcctgttcagccccatcttcctgtgccaccacgccatcatgcacagaaagatgacaagccctcacttcaggctgttcagcagcaagatcccacatcctcaggtgccatctgtggtggccctgtgcaagttccgggccttcatccacacacctagaagccctggctgcagcgtgtacgccaatatgtgctggcccaagttcttcctgaccttcagccagcagtggtccagcgtgacatctctggaatggacagcccaagagagaggctgcagcagctggctgatgaagcagacatggatgaagtcttggagcctgcgggaccccagctacagatccatcctggaatacgtgtccaccagagtgctgtggatgcctacctctaccgtgctgcaggctcatccacaagttccagctctggctcctcaagcctggtggcctgctagaagaggacctctgacatctgccccatccgctcagcagtccctgaccagagagaagattatcaaccccaccatcagctgcccctttcagagccccaccaagagactgatctaccctcctagcacctgttctctgccctgcagaggcttcctgcctagcagatttccttggggcccacctcctctgaacagcgtgatcgtgcacaagatcgtgctggtgttcctgaagtccctgtccagctacaactgcgagcggagaatcagcggcatccagaagagagccatcgagttcgccgtgctgaaactgctgaatatggacctgcctctcgagaacacacagatccccagaacaagcccactgtggaagatcacaatggtgctgacataccccaactgcgtggtgcatgtgctgatgtttggcgccctgagagccacagctcctgctacagctgcacctcaggctcagacccctcattggagagctgccacaacaagcagcatgagcagcagccctagagccgagcctacatcttctagctcttgggccacctgttggcccagatgctgctccagctcttgttactggtcactgtctagctggcctccagctggcgccgctgaagctacaaataccagaaccagaagccgcgagagccagaggggtagaatgctgacttggagaagctccctgtggttgcagggcaccagatgttttacaggcgtgcggaccagctccagatacaagaaaagaggcgtgatcgcctggcggagacagatcaatagacggaagctgcagagaaagaagcactggaacagcgcctacctgggcagaacactgctggtcacctgtatcctgtatcaccggtggatcgtgacctccatgtgtcagtcccagagatggctgaccagcaccacaagtagatctagcgccctgatgtggaccgagctgagcctggaaccatggattccctacctgcatcagcagaaaacccagcggacactggaatccgccggactgtttccttggctgcacacccagtgccaagagaagaaaagcagaaagctgatgtccagctgcacacacccctgcacaatgctgctgccacagggatgtcatcctgcctggctgagccctatctctgcctgtccaagactgctgccatatccttttcacgtgctggctctggaagtgacctttcctcctggaaccgccatgcctcagatgcagttgcaggctctggctatgtgggagaaaggctgggataagcctggcaccagcctgcagtgctacctgaacagaagaagaaacagccggaagcagagccaggtgcaactggccattcaggtgctgctcgtggacaagcacaagtactttctgttcggccaaaagaaaggccacatgatctttagcctggccaacggcctgtggtttaacctgattttcaactcccggaagaaactgctcgaggacatgaagcaaaatggcttcaccggcaaaggcctgacacaccccgtgcctctgaagcggactctgcagaacaaaagaaacaagaatatcaaacgcgtcaaccagaagaagggcaacatcaagcggaagtccatcctgctgcacctgattgtgctgaatagccccgagagcaacctgatcctgatccagcatggcggcatcttcacctttcggttctgggtcgagaagctgtcctggaacatctgcaagaacctgagcctgtacctggacaagttcgtgcagagactgctgtacgtgtacatcatcgagacaaacgtgttcgtgctgaacctgtttcatgtgcccgtgaaccagatcttcatgatggccttctacctgaagtacaccgagaaggcctgggtcatggaactggaatggctgatccaacagcagtgctatcagggcagctgcggcagagcttgttcttgtggaagaggctgtggcacccctagaggcgattggaagagacatcctcctcggagagccttctggaagcctcctagccagggcatctctagctgtctgatgaccggctgttggctcgagaagaaagctacctggatgcggcggacccgccggaagaagagggaagatcattgcggactgagacaccccagctggccttggacaagatgtctgaggatgaggcctccaagaagc

SEQ ID NO: 1098 - protein, 4518 aa, Artificial Sequence
  polynucleotide 3A
GGAGCTGCTGCTGCCTCTTGTCAGTCTCCTCCTTCTCCTCGGGAAACCACACCTAGCTCCGACGCCACCAGACGGACAAGACCTATTGCCGCTCAGAGCAAGAAAACCATGACAGCCGCCGGACTGACCCCTATGATCCGGAAGATCCAGAAGCGGCGGAGAACCGCCAACCGGTGTCTGAGAGTTAGATGTGGCGGCTGGCTGTGTGGCTGGACACCTAGAGGACAGAACACCAGAAGCACCAACCTGGAAAAGAACCCCAGCCTGAAGAAGCAGAGCCAGCGGAGAGGAAAGCTGAGCAGCCTGTTCTTCAGCCACTGCCTGTGCCGGAACAGCAGAAGGGCCACACCTACATCTAAGGGCAGCCTGCGGCGGAAGTACCTGAGAGTGCCTATTCCTCCACACCTGAGACACCCTCTGCTGCTGATGGACCTGGACGGAATGCTGACCGTGATCGGACAGGGACTCGTGGGCATGACCCCTAGAGATCTGGGAACAGTGGCTGGCGCCACCGCTCAGATTCAGAGGCCTATTCAGGTGCAGACCGGCGGCAGACTTACACCTCCTCCTCTGATTCTGTGGCCTCAGGCCGCTCCTGTTGATCCTCCTGGCTCTGTGTGGATTCTGCCCTGCAAGAACAAGAAGCGGAGAAAGCTGCGGCCCAAGCGGCTGGACTTTCACCCTAGATCTTCTAGCGGCGTGTCCGTGATCACCATGAAGCTGTGGGAGAAGCACTTCAAGGGCCTGAACTGGAACCTGGTCGTCTGGATTCTGAACCTGAAGATGATGAACATCGAGATCACCCCTCAGCGGAGCAAGGCCAGAAAGTCCGGCGTGATGAAGTGCTGGGATCTGTGCCCCAGCGAGAAGAAGAGGAAGCTGCCTCTGCCTCTGACCTTCAGCACCCTGCTGTGGGACTCTAGACATAGAGGCGCCAGCTCCAGCACCAGCAGAGACTCCAGAAGCTTTTTCACCAGCGCTCACCCCAGCAGACCCTGCAGAATGAGACTGTACCAGTTCCTGATCCACCTGAGAAAGGTGGACACCCACCATCTGCAGGTCGTGACCAAGACCGTGACAGCCACAACAGCTGACGGCCAGAGAATGCGGAGACTGAAGTGCAAGGCCTGCCGGCTGAGATGGGCTAGACCTGAACCTGCTGCTCAGGCCCCTCCAAAGAGCCACTTTCCACCTCATCCTAGCGGCCCTAGCAGAACCAGTTCTCTGCAGCTGCGGAGCATCCCTCACGTGCCAAAAGCCACAGCCGCTCACAGCGTGACAGTGAAGCTGCAGAAGGGAAAGAACAGCCCCTGCTGCCAAAAGAAACTGCGGGTGCAGAATCAGGGCCATCTGCTGATGATCCTGCTGCACAATACCTACATGGAAATGCACTACGGCCATCAGGCCCCACAGGTGGCCATGCTGCCTAAGCTGCTGTGCAGACAGATGCTGCCCACTCTGAGCACACTGCAGCAAAGACACCCACAGGGCCCTTGTCCTCCACCTGTGACACCACTGAGAGTCCAGTCTGTCCTGCTGCTGGGAGTGCCTCAGACAGCTGCTAGACAGCCTAGCAGACCCACCGGCAGAACCCCTACCACAAGACTGATGGCCCCTGTCGGCAGCGTGATGAGCTGTTCTCTGCTGACCCAGCCTTCTCCAGCCAGCGCCTGTACAATGCCTCCACTGCTGCATCCTCAGTGGGCCCCACATTCTGCTGGATTGTCTCCCGGCGCTTGCAGACCTGCCTGTACCTGTATCAGCATGACCACCATCTCCAGAGCCACCTGGCAGGTTTCCGTGTACAGCGGCAATCTGCTGAGCTTCTCCAGACGGGGCATGAAGAGTAGCGTGCGGCTGAAAAACAGCCGGCGGAACAGACGGTACAGAAAGATCTACGGCGAGCTGAAGATGTCCCTGCAGGCCGTGGCTCCTAGATGTCCTAGATCTGCCGTGGACATCAGCCCCGGACCTACCTCTCCTAGCCTGGCCTCTTGTGCCTCTGTGGCCATTGGAAAACTGGCCCTGCTTGGCGCTTCTGCCCCTTGTGGTGCTGCTGGCGCTAGAGAGGCTGGAAGATTTGCCGTGCTGGGCACCATGGTCATGAAGCACCTGAACCGCAAGCTGCATCTGACCCGGTCCTGCCTGATCGATCTGACCATGATGATGAGCCAGAAGCTCTGGAAGAACCAGCGGAAGAGAATCCCTCTGCCATCTCCTAGACAGCATCTGCTCCCTCAGTACCCTCTGCACCCTCCTCCACCTTGTCTGCTGCTGCTCCACCACAGACACCACCTGGCCTTTCTGGAAATGGCCTGCAGCAGCCAGCACACCCACTCCATCAAGATCTGGATCAGCTTTAGCCACGAGCAGAGCAGCCCATTCCTGGCCAGATCCTGGAACACCATGCAGTGGAACAACAAGAAAATGGCCATGACAGTGATCGCTGGCGCCCACCACTGTCAGTACAAGCTGACCTACACCAAAGTGTGGAAGATGAATTGGAAGAAAATGATGATCGGCTCCCAGCACCTCCTGTTCAGCCCTCTGGATAGCTCTCCACTGCAACTGCTGCTTCACCCTCACGGCAAGAGATGCAACCCTTGCTGCAGACTGACATGGATGTCCATGCTGCAGAAACAGTGCTGCTACAACCTCGTGATCAAGCACCCACTGATCTTCAGAATCAACCTGCGGAGACAGGGCAAGACCAAGGATGGCGTTGTGCAGAGCCTGGGCTTCCTGAACCAGCAGATCATCCTGCAGAAAGAGTTCTTCATCTGCCTGCTCATGTTTATCAAGCGGTGGAAGCCTGCCGCCACCAAGAGAGAGTGGGAGAAACGCAAGCAGATCCTCGGCGGAGGCGGCAAGTACAAAGAGTACTTCCTGAAGCGCATCCTGATTCGGAAGGCCATGACTGTGCTGGCCGGCGACAAGAAAGGCCTGGGCAGATTCATGAGATGCGTGCAGAGCGAGACAAAGGCCGTTAGCCTGCAGCTCCCACTCGGAAGAGGCCCTGTGTACTACGTGTGCAACCGGATGAACGTGTCCAGCGTGCTGAAGCCCTTCCTGTTCACCGTGCCTATCGAGGACATGAGAGAGTGCACACTGGGCCGCAACAGAATGAATGTGTCCTCTGTGCTGAAACCCTGTCTGATCCCTGTGCCAATCGACCTGCCTCGGATGCTGCCAATCAGCAGCCCACTGCACAGACCCCAGATGCCATTCTGGACCTGCACCTTTCCTGCCACAACATGGGGCACCTGGGAGACACCTTCTACATGGGGCTGGCGGACCTTTCGGGGCCCTAGAAGAAAAGTGCTGATGGTGCTGTGGCTGCCCGCCAACCAGAGTCTGCAGAAAAGCCAAGTGTTCCAGTGGGTCCTGCGGACCGAGAACATCCGGAAGCTGATCTGGACCAAGCAGCGGAGCTTCCTGTCTCTGTTCCCCAAGCTGAGAGCCACCGAACAGATGACCAATGTGGGCTGCGCCTTCAGCGGCCGGATTCTGCATCAACCTGAAATGGCCGCCATGCGGCTGATGCCCAAGTTCCTGAATAGCACCAACAGCTGGTGGACCTGTACCAACCTGAGCGTGCCCATGATGCTGACCATTCTGATTTGGAAGCGGGTGTTCATTCTCCTGCTGTCCGACAAGAAGCTGCTGAAGAAGTCTAGCCAGCTGAGGCGGTCTTGGAGAAACGTGTCCCGGATCAGCCACCAGATGAAGTGTCTGACCGCCGTGGACTGTCTGCAGGCCTTCTGGGACATGAACATGGAACACCGGCTGACCATGGACAGCGCCCTGAGCCTGACAAAGAGAGAGGGACCCGAGACTTGCAAGAAGAAGCTCCTGCTGAAACTGCTGACAATGAGCCTGAGCAACATCCTGATGAAGTTCCGGCTGCGGCTGAGAATCCCAAGCCTGAGGAAGTATCGCCAGCATCTGAAAAAGACCAGCGCCAAGGGCGAGAAGCTGAAGCACTGCTTTAAGGCTTGGGGCAGAGGCCCACCTCTGCACACAAGAAGCCAGAAGAAAGACCCTGCCGGCAAGCTGAAAAAACTGACCACACTGAGCTTCGTGCTGATCGAGGAACGGCGGAACCTGCAGCGGAATCTGAAAGTCCTGTGGCTCAAGAAAAGCACCAAGAGCCGGTATCTGTTCTTCCTGACCGTGTGCGGCTTCTTCGAGAAGAAACGGCCTGAGTGGCTGTCCTCCAGAAAGAAGGGACACACAAAGAATCGGAGGAAGGCCAAGCGGAAGCCCCAGATCGTGCACAAGAAGAGAGGCCTGTTCCTCAAAAAGAAATACCTGGTGCAGGGCGCCAAGAAGATCACCTTCCTGTCCAACGGCATGGAAGCTTGCGGCACACACCCCACACCAAGACTGAGCGACAGAGTGTTCCTGGTCAAGATCACCACCACCACAAGCAGCCCCAGAAGAAGCCCAGCACTGAGAGCTAGAGGCGGCACCACAATTGGCGAAGTGACCAGCCTGTGCTTCTTCTACCTGCTGTAC

SEQ ID NO: 1099 - protein, 4521 aa, Artificial Sequence
  polynucleotide 4A
ATCCAGAAGAAGAAACAGAAATCCATGGCCAAGAAGTCCCAGCAGCCTCTGGTGCTGAAGAAGAACCGGAAGCAAGAGTGGGGAGGACAGGCCCACAGACAGAGAAACAACGCCAAGAAGATGCCCTTCCAAGAGGAAAAGAAGAACGGCCGGATCAGCAGCAGCCTGATCCTGAGCTTCCAGAGAGTGAAGGACAGCAAGAAAATGACCCAGAAGATGTGCAGCTCTCTGGCCCTGCCTACAGGCCTGACATCTCTGATCCTGCCTAGCAGCGATCTGGCCGTGCTGATCTCTAGCAGCACCAGCCACTTTCTGATGCGGAGCCCTGTGCTGCCAAGCTCCAGACTGACATGTGCCTCTCCACAGCTGCCCCGGATGTGGACATGGTCTAGCTGGCTGAAGCACCCCAGAACCGCTAGCATCACACTGCCTACCACAAGCCTGAAGGGCAGCAGAACCAGCTGCTGCCCAAGATCTCACCCCAGACTGCCTAGGACCAAGTGGCCTCTGCAGTGTCTGCTGCACAGCCTGGGAACAACAGGCACACTCGTTTGGGAAAGGGGCGTGCTGCAGATGAGAAGCCTCGAAGCCCATTGTCCTCTGCAGACCTTCCATCTGCACCACTGCAGAACCCAGCCAAGCTCTTGTCCTCCTGCCTGGATTCTGTACCAAGGCCAGTGGAGCGGAGCCGTCGTTGGACTTAGACCCGTGGCTCACCATCTGCCTAGACCTATCCAGGGCCTGCACTGTCCTCAGGCTCCTCATCAACCTGCTCTGAGCTGGGGAAAGTGGCCCGTGGGAATGACAGGACCTGCCAGATGCTGTCGGTGGCCCCGCAGATCTCAGAAGTCTCAGCATCACTGCGCCCTGCGGAAGATCGAGTGGGCCACAAAACTGTCTCTCGGCGGAAAAGCCGGACCACAGGCTCAAGAGAAGGCCAGACCTTCTCCTTGCCTGTCCTGGTCCAGCAGAATTGTGGCCCCTGGACACGCCCTGAGCTGTCGGACTCGTAGAAGATGGTCCTCCAAGTGCAGAGGCGGCCCTAGCGCCAGCGATAGATGTTGTAGCTGTAGCCCCAGCGGCTTCAGCGCCGGAAGAGGCAGATGTCCTGTGCAGGGATGTCTGAGGCCACACAGAGTTCAGCTGCTGAGAAGATGGGGCCCAGGATCTCCTGCTGGCCAGAGACTGTCTAAGGGCTTCCAACTGCTGCGTTGGTGGGGACCTGGATCTCCAGCTCCTGAGCCTAGAAAGGGCCCATTTCCTCCACCTGATCCTCCATGGCCTGTGACCGCTGTGACAGTGATGGCTGGCTCTGTGCCTAGCGCACAGTCTGTGGATGCCCTGGAATCTCCTGGACCTCTGGCTCTGGAAGGCCCTAGCAGCCCTAGAAACCTGCTGTGGCGGGAAATGAGCATCTTTCTGCCCGGCATCTTCTGCCAAAAGAAGGTGCCATCTGCCAGCCCCTGGGGACTTGTTCCTCCTTCTCCACCACTCGCTCTGGGCCCTAGAATGCAGCTGTGTACCCAGCTCGCCAGATTCTTCCCCATCACACCTCCAGTGTGGCACATCCTGGGACCTCAGAGACACACACCTCAGGTGGTCCTGAGACTGGGCAACCTGCCTCCATTCTTCAGAGGCAGCGAGGTGCCCTTTCCTAGACCTTGCCGGACCAAGAACGAGGGCAACAATCACTGGCCCAGAGTGGAAATGCCTACCGGCTGGCTGCTCGTGGGCTACAACACCAGAAACACAGCCCAGAATCCTCGGCTGCAGCAGCATCTGAAACACTGGCAGCAGTGCACACGGGCCAGATGGTGTCAAGAGCCTTGTCAGACCCTGACCTTCTTCCACTTCTTCTTCTTTTTCAAAACGGTGTCCCTGTGTTGTCCCGGCTGGTCCAAAGGACAACCTCCACCTCCTGGCCTGAAGCCTTCTAGCCTGGCTTCTCAGGTGGCCAGAACCACAGGCGTGTACCAGCACGTGTGGCTGATCTGCTTCGTGTTCTTCGTGTGCGTGGAAACCGGCTTCTGTCACGTGGCACAAGTGGGCCTCGAGAGACTGGTTTCTCTGAGCGGCATCACCGACGTGAACCATTGGGCCCAGCCTAAGCCATCTCCTAGCAAAGGCACCGGCATGAACAGACCCATCGGCCTGAGAGTTGGCAAAGGCGTGTGGGCCAGACTGCTCAAGAAGAAGCCTAGAGACATCTGTCGGATCTCCAACAGAAAGACCCGGAAGGCCGCCAGAGAGAAGCACCGCAAAACAGATAGAGCCAGCGTGTCCTTCTGGACTCTGCTGCCTACAACAGGCGTGCGGACAAGAGGAAGCCCTCTGAGACTGACTCTGTGGCCTCCTAGATGCAGATGCAGACGCGAGTACAGAGTGACCATGAACATCCTGAACAGCCTGCCAAGCAGCATGGAAATCGCCGTGCTGCAAGAAACCGCCAAGAAAAGCCCTACCAGCTTCTGCTGCAACCTGGACCTGCAGCATCAGCGCAGACGCAAAAAGAAGAAAGACAAGGTCGAGATCCGGAATCGGAGCCCCAAGGCCAATAGCACAGAGTGTCAGGGCGAGCACAGCAGAGAGCAGAATCTGCTGAATCTGGTGCAGCTGAATCCTCACAGCCCTCACCACCGGAAGGACGAAGAGGACCACCAGAAGAGACACCACCACCACAATCAAAAGAAGATGAGCGTCCCACTGTTCTTCCACGGCGACCTGTGTAGAGAGAGCACCCTGGGCAATTTCTGGATGAAGCTGCTCCAGCTGCCTCAGAGGCCTCCACTGCAACCAGTGACCGGAATGGAAATCCTGCTTTGGATTCTGCTGAAGATGGAAATTCAGATCTTCAAGATTTGCCTGGGCGAGATGCAGCTCTGCACCTCTCGGATTCTGAACCTGCAAGTGCTGAAAAAGATCCTGCGGAGCTTTATGAAGCTGTACCACAGCCTCGTGATGTGCCTGCGGCTGAGGACCAAGCTGGAAAAGGCTCTGAGCGCCCTGTTCATCTGGCCTCAGCACTCCTACAAGATCACACACCCATTCGCCAGCCAGCCACTGGGACAAGAGATGCCCAACAACACCCAGATCCGGCTGCTGAAGCCCGACAAGAAGAAGAAAAGCACCGAAAAGACCAAAGGCCAGGCTTTCGGCAGCTTCTCCGCCGATTTTTCAGCCCCTCAAGGACAGGCTTTTGGCTCCCTGTGTCAGCTGGTGTCCGCCGACTTTAGCGCCCCACAAGTGACCAGACTGCGGAGCCTGAACCATCTGCTGATTTGGCTGAAGAATTGGAAGCGGTTCAAGCTCAAAAAGAAATATCAGGCCCCTCTGCGGCTGTGGTCTTGGTGCGGAACAAGCCAGACCTACTTCGGCAGCATCATCTGTATCAAGAATATGTTCCTGCAGCGGAAGGGTTTCCTGAACCTGAGCCACGTGGAAAAGTTCGAGCTTAAGAAGAATCTTCTGCTCCCCGTCGTGATCAACCTGAAGAGACTGCAGAAATTCATGCTGAACCAGAAGTGCCTGGCTCCATTTCCTGCCTGCACCAGCAAAGCCTGGACACCCAGAAAACTCGTGGGCAGAGCCGTGCGGAGAAAGGGCATTCTGGCCATGACACTGACCCTGAACGGAATCGAGGCCCTGACAGCCCTGTTTACCTGTAGAACCGCCTCCATCAGCGTGAACATCAGCACCCTGATGAGCATCCTGGAAGCCATCATCAAGAAGATGAAGAAACGGATCATGGTGCACCGGTGGATCTTCTCCAATCAGCTGACCGTGCAGATGCTCTGCCTGCCTCTGCTGACCCCTGACACCAGATGGATCTTTAGTAATCAGCTGCAGACAGTGCAAATGCTGTGTCTGCCACCTCTGAAGCAGGGCGAGAGAATCATTTGGCCACTCGGCGGCTTTCAGATCCCCAATTTCTTCTGGTCCCTCGGCATCGGACACACTGGCGCATGGTGGCATACTGGTAGAAGGCGGAGAGAGTGGGGCGGCTCTACCGTGTCTAGAAGCCCACTGTGGATCAGCTCCATGATCTACCTGAGAGGCATGGCCTTCGCCAGCGACAGCTCCATCAGAACCACCAGAGTGTCCTGGTGTCGGAGATGTGGCGCCAAGTCTGCCGCAGCCTCTTCTTCTCCACTGTGGGATTGCAGCACCACAACCGGCACACACCACGGATGCCTGTGGGAGATCCCTAGCGTTACCCTGCTGGCTAACCTGCACCTGTGCTACTACCACTCTCAGAGCAACAGAAACAAGAGCCGCCAGATGGAATCCCTGGGCATGAAGCTCCAACTTAAAAAGAAAGTGAACGCCTGCAGCACCTACACACCCCACATCTGCAGACACACCTGTCGCGTGAACGCCGTCGAGGAACTGCACTCTAGAAGGATGTCCGTGCGGATCGTGAAAAATTGGGTGTCCTGCTGCTACGTGCGGCTGTCAGCTGTGGGACTGTCTACTTGGAGCGCTCTGGACAACAAGATCATCTGCAAGGGCCACAGAATCACC

SEQ ID NO: 1100 - DNA, 4521 bp, Artificial Sequence
  polynucleotide 1B
accgagatccaattgaccatgaacgacagcaagcacaagctggaaagccccgctctgaaacaggtgtcaccagcctctccacctactcagcagcctcagacacctcaggatagcagacaggtgctggccatgcctagcagctggtctagctctggcagaacccagcggaaggtggtcaagaatcctagccagcctgtgcctctgagaaacgacggcatcaccaacggcaacgactccaccagaagctgcagcatcagcctgaagaaaagcctggaaaagatgcccctcatgatgaagaagaaggacagcaccatcttcatcgtgcccatgagcctggcctgtagcatcaccgtgtctttcgtgggccagatcagcacactggtgctggatgtgtccagcatctcccactggaacaaagtgcggcagaacttcaagcggaacgccgacaagaagaacgttcggagcggcgagaagaacgacctgcagctgtttgtgatgagcgacaccacctacaagatctactggaccgtgatcctgctgaacccctgcggcaatctgcacctgaaaaccaccagcctgggcgactgtcctagaacaatggccggaccttctgcctctctgcaccctgcatctggcagagcctctagaaagacctggcagagaaggctgagagcctgtagagctggtggacctgctggatgggccagacaggccttcgataagaaaggctttgtgatcctgagcgtcggagccggaacaggcggaggacctgcttgtgttcctgtggctgaagcttctacaggcgcttggacagctgaaggcgccgctggaacaagatgtagagcttctagagccccttgcagacagctgcctgccagctctcctaccaagtgcgagatctgcgtgaagcgcagacggcggagaaagagaagcagccagtctagaagccccgtgcctaagaaacgcgagagaatgatgctgcccgtgcgggccagaacagctagatctgcacttcctcaggggagagcccctcttgagggaatgctgcttcctagagcactgcccagcctgctgtctagaatgccagccagaagagagagccggttttggctggctctgcaggcacttggactcagacctccacatctgcctagctgtcatcctctgcctcaactgcttggccctccacctcctcatcaggcccctacagctttcttcctgctggacatcattctgcggctgccctgcaaagtgaccgagtctagcaatatgggcggcaacagatccatctgcctgaccaacgccaagaaaatggaagatatgatctgggagagcacgcccctgagcatcagcagacctacatctagagccaggcagagctgttgtctgcccggactgacacatcctgctcaccagccactgggatctatgaccctggccatcagattcatcagcgctcctcagcctagctccagcacagtgacagctgctcctagcggccagtacttcaagggcaagaagcggcggaaagagatcttcaagaagaagaaacccctgacattcagccccagcctggccaaaaagaccctgaccaatagcagcttcttctacaccagcgaccgcgaggccaagaaatctatgaagcggagcatgaccctgaaggccctggtcaagacctggacacagttcagaaactaccccagagcctcctctcctggacaccctctgggacctaatggcatctgggaagtgatgcccagaacactggaaggctgcatctccgtgaaggaccacagaacaagccagaaccacagcaagtgcatcaccgagtgtgtgcggacagccctgaacagaagaagcaagatcgaggcctctcctatcggctctatcgccctgagatccatgcctaagagcagaaaccaggtgctgttcagacggaatctgaccccaagccagctgagaactctggcccctccttatatgctgctgccccagtctctgagccagagcctgagcagaaagcagatccctagccagtccatgctggtggcctctagagcaggacagtttcctgtgtggcggagaaccagcagaggaatgagcctgcagtggaagtccggcaatgcctgcacacctctgagatgccctagcagaagccctgccacattcctgacagctctgaacggctggcacagatctggactgagagcccagagaaagcgcaagcgcgagaagagaagccagaagtccaggcagaaccatctgcagctgaagtcctgccggcgcaagatctccaactggtccaagctgagaagcccctggatcttcgtgtccaagaagagactgcccaagctgaccaagtgtgaaatctgtgtcaagaacaccgccatcctggctatcaccctgatcacccctcaggaccctcatctggaccctgtgtgtcaccctcatagaaggcctggatggaagggccaccacagagtggtgttttctcatcaccctagcggcagcaccaagagccactggcagcaaagagaacgcggaggcggcagacgggaaaagaagggctgtagagagagatccctgctgtactccagaatgtgcctggtgcagatccccacacacacctgggagcccgattacttcgtgtctctgcccatgatgttcagctgggccacacagtcattccccgtgggagccgtgtttctgaccagacctgccattccttgctgtagctgcacaagccacagcaacccttggagtcagagcagacacccacacagaagcccacctacctcttgtcctccgctgctggaagcctttccactgcctagagcatccctgagagccaccgtgccaagacatagctctgtgctggcaaccggactgcatctgcacagacagatttctctgcccctgagaggattcctgctgcatcaaccactgccaggccagcatctgtggctgtctcatagactgcggctgagactgccaagaactcagcggcctcctagatccatcctgagccttagactgccactgaggccacagagaggacccagacctctgcatagatggctgcagcagaccacaggctgtagccagagaagataccccagactgaaaaccttcggcgtgccactgggctccattctgtgtctggctggatctctgagcaccatgatgatcattagcaccaccagacaagagtgtggcaggcgggcatctgtgccctgtagacctatgatcggaagcgccagaccaggaccttggagaacatctgctatgcctagcgccatgggcgtcgcactgcctacaagctgtgaatccggaagatctcctcctgccaccggcggaagaatgcctggaagccagagcattatgatgagctggatgcctcctctggctccttgtgccgcttgtccttgttctcccgctcctacactgtgtcccgctcatcctgctagagcacctacagccgtgcctgcctttacacctctgtctgcacatcctgtgcctgtgctgtctggatgtcacctggccgtcagaacctccatgctgacactgctgcctatgctgaagctggccccactgcaagtgaccaccacactgaagctgatcctggtcatgctggaaatcgtgaccgagagcactcggagagagatgccttctcaggccacaccttctccacctggaccttggcgagccgctctgggcaaagaagtgaagagatcccagagcaagctgcgcctgagaaacacaagccccatcgtgttctttctggccccatacttccccagacggatgaccagacggaccatgacaaccaccaaaatgatgatgatgcggcggaccaagcggagaaggcgcaaaaggcggagaatgacaatgatgacaaggcggaccctgctgacaaagaaaacctgtctgacccctagaaccagcgccgctaccaaagctctgccaaggcagacaatctcccagcggaggcctattcagacccctcctggaacatctctggccatctggggcaaccagcagctgaaatggacccctcacatcctgaagtccgccagcagaagggccagacctaccagctgtagcacctgtagaatgtggtggatcgccaaaaagcggatcaagctgcggcggaacagaaccagactgacactgacaggcacaagaagcagcggcaccagagcttctccatccgccgtttgcctgtgttgctggacctgtccttccagaagcttcccagccgcttctccaagcggattgagagcacctgttggagcacaggcccctccagaagttacactgagagctagctgtgcctccagcgcctctaaggcttgtgctggactttggccttggggagcacaagttcggcaaccatctttgcctggaccatgcgcttctctgctgagcacactgtctcagccacctccacaggctccatctcaagtgtggacagccgcaacactgagatgtcctgctgttccagctgctgcctgtcctcct

SEQ ID NO: 1101 - DNA, 4053 bp, Artificial Sequence
  polynucleotide 2B
agaaagatgcagagcctgaatcaccccagcagactgaccaacatgagcagaacacctccaagacgcgtgtgcaaccctcggagaaagacctggaagatgcggaagaagtacgcccagaagcctagccagaagaaccacctgtacaacagccggaagaaactgctcgaggacatgaagcagaatggcttcacaggccacagagagggcagcgagtctgataatctgggcctgctgtactcctttcctcctatccggatgtgcgccctgtctcaccctagcttctacatcagcagcaccgtgtgctttctgagcaagcactgcatgaccgcctgcacacaaaagaaaggccacatgatcttcagccgcgagaagatcatcaaccccaccatcagctgcccctttcagagccccacaaagcggctggaactgagcctggaaccttggattccctacctgcaccagcagaaaacccaaggcggcaagaagagaagcaagttccctggcaccagcctgcagtgctacctgaacagatgcagcctgatggaacagatccctcacctgaagtccgcctctccacagatcatgcagagaaccagcgccgaccggttccggatgaagcggagaatgcagaacctggacaatctgggcgttccatggccactgctgcctggacctctggaaaacacacagatccccagaacaagccctctgtggaagatcacaatggtgctgacataccccaactgcgtggtgcacgtgctgatgttctggctgcctatgagatctctgggcgagccttggagagctggctttcagtggggagagtccccttggcaagtgatggctagcctgacaggcccctatcctatcagcgagggcctgaccatgaccaccggcagaaacatcaacagcaactccctgatgaccaactgcctgttcagccccatcttcctgtgccaccacgccatcatgcaccggaagatgacaagcccacacttcagactgttcagcagcaagatcccacatcctcaggtgccatctgtggtggccctgtgcaagttcagagccacatttctgctcgccctgtgggagtgtagtctgcctcaagccagactgtgcctgatcgtgtctagaaccctgctgctggttcagtctgccgctcctccacatagactgctgggcccttctagatggtccagaagccacctggacttcagcccctactggatgaagaaagtgaagctggccaacggcctgtggttcaacctgatcttcgtgctgttcaaggccgaccagagcgagtctagcctgtctagcggccggaacaagaaaacaaagctgtggttctccctcatcaacatccaccaccgcaagaatcctctgctgcccatgagaatccccagcctgaatgcccagtggatgttcctgagaatcctgcttctggcccatatgtacggcttcagcacctacggcacccagaaaggcgagtgcgtttgtctgcagtgtctgagcggcagcagcctgttcattctgaagcagcccctggacctgaagatctccaagaccttcatgctgcaagctcacccacaggtgccagctcttgctcctcaagcttggtggcctgctagaagaggccctctgacatctgctccatccgctcagcagtctctgacagctagccctcagattatgcagcggatgagcgccgtgaacttcgagacaatcatctaccctccaagcacctgtagcctgccttgtagaggcagaacactggaaagcgccggactgtttccttggctgcacacccagtgtacacacccctgtaccatgctgctgccacaaggctggtggtgtacaagaggcggcggaaagcggaaaaagaaaatgtgcaaggtgtccggcggctgcaccgcctgtgttgagagatgtccttggaagggcatctgctggaagtggccagtgacagtggctgctcagtggtctagcgtgacctctctggaatggacagcccaagagagaggctgcagcagctggctgatgaagcaaacatggatgaagtcttggtccctgcgggaccccagctacagatccatcctggaatacgtgtccaccagagtgctgtggatgcccacaagcaccgtgcggagaagaaacagcagaaagcagtctcaggtgcagctggccattcaggtgctgctcgtggacaagcacaagtactttctgttcggcagagcccgcaaccggaacatgaagaaaaccatgagccacctgatcgcccatcaggccctgaagatgagcggcctgaggctgtttcatcctcggctgctgacaagaaagaagcccggcaagttcctgcctagcagatttccttggggccctcctcctctgtgtcatcctgcttggctgagccctatctccgcctgtccaagactgctgccatatccttttcacgtgctggccctggaagtgacctttccacctggaacagccatgcctcagatgcaactgcaggccctggccatgtgggagaaaggctgggataagcggaagagaatgaagaccggcgccatccaagagaagggcgctattcaagagaaaggggccatgaccaagcggatctgcgtggtcaatttcgaggcctgcagagagatggaaagcctgagcgcccctgagaagattaccctgtttgaagcccatatggcccggtgcacctccatcaatgtgctgtgtgtcagagcctctctgatcgagaagctgatgaaagaaaagcgcaagatgaagcgcaaccaggtggcatccccacaaattatgcagaggctgttcattaagggctaccagaacaaccacttcaccttccatctgcaaaacttcgccttcttcagcagcttcggcaacaacaagtacatcaatatcctgacgcggcgcaagaaaagagaggaccactgcggactgctgatcctgatccagcacggcggcatcttcacctttcggttctgggtcgaaaagctgagctggaacatctgcaagaacctgagcctgtacctggataagttcgtgcagcggctgctgtacgtgtacatcatcgagacaaacgtgttcgtgctgaacctgttccacgtgccagtgaaccagatcttcatgatggccttctacctgaagtacaccgagaaggcctgggtcatggaactggaatggctgatccaacagcagtgttaccagcaagagaagaaaagccggaaactgatgagcagctgccgggccttcatccacacacctagaagccctggctgcagcgtgtacgccaatatgtgctgggccttttggaagcctcctagccagggcatcagctcttgtctgatgacaggctgttggggcagccctcctctgcacctgtgtcagcctctgaggcggtataagaaaaggggcgtgatcgcctggcggcggagaaagtggcagatccggcatgtgctgaaaaacctgatcctgtttcatgtgcggaacatcgtgtacggcatccaagtgatgctgtgcggcaagggactgacacaccctgtgcctctgaaacggaccctgcagaacaagaggaacaagaacatcaagcgggtcaaccagaagaagggcaacatcaagaggaagtccatcctgctgcacctcattgtgctgaatagccccgagagcaaccccaagttcttcctgacctttagccagctcgagaagaaagctacctggatgagaagaacaggcgccctgagagccacagctcctgctacagcagctcctcaggctcagactcctcattggagagccgccacaacaagcagcatgagcagcagccctagagccgagcctacatcttctagctcttgggccacctgttggcccagatgctgtagctccagctgttactggtccctgagttcttggcctcctgctggcgccgctgaggctacaaacaccagaactagaagcagagagtcccagcggggcagaatgctgacttggagaagtagtctgtggctgcagggcaccagatgttttacaggcgtgcggaca

SEQ ID NO: 1102 - DNA, 4518 bp, Artificial Sequence
  polynucleotide 3B
ggagctgctgctgcctcttgtcagtctcctccttctcctcgggaaaccacacctagctccgacgccaccagacggacaagaccaattgccgctcagagcaagaaaaccatgacagccgccggactgacccctaagaacaagaagcggagaaagctgcggcccaagatgatccggaagatccagaagagaaggcggaccgccaaccggcggaatagcagaagggctacccctacaagcaagggcagcctgagaagaaagtacctgagagtgcggggacctcctctgcacacccggaacatcagaaagctgatctggaccaagcagcggagcttcctgtctctgttccccaagctgagagccaccgagcagatgaccaatgtgggctgctctatccctcacgtgcccaaagccacagccgctcactctgtgacagtgaaactgcagctgcccctgaccttcagcaccctgctgtgggatagcagacacaccatgagcctgagcaacatcctgatgaagttccggctgcagtctagcccattcctggccagatcctggaacaccatgcagtggaacaacaagaaaatggccatgaccgtgatcgctggcgcccaccactgtcagtacaagctgacctacaccaaagtgtggaagatgaactggaagaaaatgatgatcggcagccagcatctgctgttcagccctctggatagcagtcccctgcagctcctgctgcaccctcacggcaagagatgcaacccttgctgcagactgacctggatgagccagaacaccagaagcaccaacctggaaaagaaccccagcctgaagaagcagagccagcggagaggaaagctgagcgcctttagcggcagaatcctgcaccagccagaaatggccgccatgagactgatgcccaagttcctgaactccaccaacagctggtggaccctgaccacactgagcttcgtgctgatcgaggaagccagacagcccagcagacctaccggcagaacacctaccaccagactgatggcccctgtgggcagcgtgatgagctgttctctgctgacccagccttctccagccagcgcctgtacaatgcctccactgctgcatccacagtgggcccctcatagtgctggactttctccaggcgcttgcagacctgcctgcacctgtatcagcatgaccaccatcagcagggccacatggggcccagtgtactacgtgtgcaaccggatgaacgtgtccagcgtgctgaagcccttcctgttcaccgtgcctatcgaggacatgagagagtgcaccctgggcagaaacagaatgaatgtgtcctctgtgctgaaaccctgtctgatccctgtgccaatcagcgagaagaagaggaagctgcccaacatcgagatcacccctcagcggtctaaggccatgctgcagaagcagtgctgctacaacctcgtgatcaagcaccctctgatcttcagaatcaacctgcggcggcagggcaagaccaaagatggcgttgtgcagagcctgggcttcctcaaccagcagatcatcctgcagaaagagttcttcatctgcctgctcatgttcatcaagcggtggaagcctgccgccaccaagagcagaaagaagggccacaccaagaacagacggaaggccaagagaaagccccagatctacctgttcttcctgaccgtgtgcggctttcacctgaaaaagaccagcgccaagtggctgaagaagtccaccaagtccagatccaacggcatggaagcttgcggcacacaccccactcctagactgagctgcctgagagttagatgcggcggctggctgtgtggctggacacctagaggtagaaagtccggcgtgatgaagtgctgggatctgtgccccgtgcacaagaagagaggcctgttcagactggattttcaccccagaagcagctccggcaagggaaagaacagcccctgctgccaaaagaaactgcgggtgcagaaccagggccatctgctgatgattctgctgcacaatgaccgggtgttcctcgtgaagatcggcgagaagctgaagcactgtttcaaggcctggggctccagacggaaccggcggtacagaaagatctacggcgagctgaagatgtccctgcaggccttcctgatccacctgagaaaggtggacacccaccacctccaggtggtcaccaaaacagtgaccgccacaacagccgacggccagagaatgcggagactgaagtgcaaggcctgccggctgagatgggccagacctgaacctgctgctcaggcccctcctaagagccactttccacctcatcctagcggccccagcagaacaagtagcctgcagctgagaagcctgttctttagccactgcctgtgcagccagaagaaggaccctgccggcaagctgaaaaagctgctgaagaaaagcagccagctgcggagaagctggcgcaatgtgtccagaatcagcacccctcctccactgatcctgtggcctcaagctgctcctgtgtccgtgatcaccatgaagctgtgggagaagcacttcaagggcctgaattggaacctggtcgtgtggattctgaacctgaagatgatgacctacatggaaatgcactacggccatcaggccccacaggtggcaatgctgcctaagctgctgtgcagacagatgctgcccactctgagcacactgcagcagagacatcctcagggcccttgtcctcctcctgtgacacctctgagagtccagtctgtcctgctgctgggagtgcctcagacagccagaggacctagaagaaaggtcctgatggtgctgtggctgcccgccaatcagtctctgcagaaaagccaggttttccagtgggtgctgcggacagaggtggcccctagatgtcctagatctgccgtggacatcagccccggacctacatctcctagcctggcctcttgtgcctctgtggccattggaaagctggcactgcttggcgcctctgctccttgtggtgctgctggcgctagagaggccggaagatttgctgtgctgggcaccatggtcatgaagctttgtttcttctacctgctgtaccggctgcgcatcccaagcctgaggaagtacagacagcacctgaaccggaagctgcacctgacaagatcctgcctgatcgatctgaccatgatgatgtcccagaagctctggaagaaccagcggaagagaatccctctgccatctccacggcaacatctgctgccacagtaccctctgcacccacctccaccttgtctgctgttgctgcaccatagacaccacctggcctttctcgagatggcctgtagctctcagcacacccacagcatcaagatctggatcagcttcagccatgaagtggaccctccaggcagcgtgtggatactgccttgcgatctgcctcggatgctgccaatctcttcacccctgcacagaccccagatgcctttctggacctgcacctttcctgccacaacctggggcacatgggagacaccttctacatggggctggcggactttcagaggcgctagcagcagcacatcccgggacagcagatccttcttcacctctgctcaccctagcaggccctgcagaatgagactgtaccagtgcaagaagaagctcctcctgaaactgctgaccaccaccacaagcagccccagaagatcccctgctctgagagcaagaggcggcaccacaatcggcgaagtgaccagctgtaccaacctgagcgtgcccatgatgctgaccatcctgatttggaagcgggtgttcatcctcctgctgagcgataagaagggcgccaagaagatcaccttcctgcctattcctccacacctgagacaccctctgctgctgttcgagaagaaacggcctgagtggctgagcatggacctggacggaatgctgacagtgatcggccagggactcgtgggcatgacccctagagatctgggaacagtggcaggcgccaccgctcagattcagcgacctatccaggtgcagactggcggcagactcagaagaaacctgcagagaaacctgaaggtgctccaggtgtccgtgtacagcggcaacctgctgtcctttagcagacggggcatgaagtctagcgtgcggctgaaaaaccgcgagtgggagaaacggaagcagattctcggaggcggcggaaagtacaaagagtacttcctgaagcgcatcctcatccggaaggctatgacagtgctggccggcgacaagaaaggactgggcagattcatgagatgcgtgcagagcgagacaaaggccgtgtctctgcaactgcctctgggaagaaacatggaacaccggttgaccatggacagcgccctgagcctgacaaagagagagggacccgagacactcaaaaagaaatacctggtccagcaccagatgaagtgtctgaccgccgtggattgtctgcaggctttttgggacatg

SEQ ID NO: 1103 - DNA, 4521 bp, Artificial Sequence
  polynucleotide 4B
atccagaagaagaagcagaagtccaacctggacctgcagcaccagcgcagacgcaaaaagaagaaggacaaggtcgagatccggaatcggagccccaaggccaatagcacagagtgtcagggcgagcacagcagagagcagaacctgctgaatctggtgcagctgaaccctcacagccctcaccacagaaaggacgaagaggaccaccagaagcggcaccaccaccacaatcaaaagaaaatgagcgtgatggccaagaagtcccagcagcctctcggacaggcctttggctctctgtgtcagctggtgtccgccgatttcagcgcccctcaagtgaccagactgcggagcctgaaccatctgctgatcaacgagggcaacaaccactggcctagagtggaaatgcctaccggttggctgctcgtgggctacaacaccagaaacacagcccagaatcctcggctgcagcagcacctgaaacactggcagcagtgcaccagagccagatggtgccaagagccttgtcagaccctgaccttcttccatttcttcttctttttcaaaacggtgtccctgtgctgccccggctggtctaaaggacaacctcctccacctggcctgaagccttctagcctggcttctcaggtggccagaaccacaggcgtgtaccagcacgtgtggctgatctgcttcgtgttcttcgtgtgcgtggaaaccggcttctgtcacgtggcccaagtgggactcgagagactggtgtctctgagcggcatcaccgacgtgaaccattgggcccagcctaagccatctcctagcaaaggcaccggcatgaacagacccatcggcctgagagttggcaaaggcgtgtgggccagactgagagcctccgtgtctttctggaccctgctgcctacaacaggcgtgcggacaagaggaagccctctgagactgacactgtggcctccacggaacatcctgaacagcctgcctagcagcatggaaatcgccgtgctgcaagagaaccgcaagaccagaaaggccgccagagagaagcacagaaagaccgacaacctgcacctgtgctactaccacagccagagcaaccggaacaagagccggcagatggaaagcctgggcatgaagctgcagagccctctgtgggattgctccaccacaacaggcacacaccacggctgtctgtgggagatccctagcgttacactgctggcctgcagagtgaacgccgtggaagaactgcacagcaggcggatgtctgtgcggatcgtgaagaactgggtgtcctgctgttacgtgcgcctgtctgctgtgggcctgtctacttggagcgccctggacgtggtcatcaacctgaagcggctgcagaagttcagccagaagtctcagcaccactgcgccctgagaaagatcgagtgggccacaaagctgagcctcggcggaaaagctggaccccaggctcaagagaaggccaacgccaagaagatgcccttccagcggtggatcttcagcaatcagctgaccgtgcagatgctgtgcctgcctattgaagccctgactgccctgttcacctgtcggacagccagcatcagcgtgaacatcagcaccctgatgagcatcctggaagcccctctgttttttcacggcgacctgtgcgaggaaaagaagaacggccggatcagcagccaggctcctctcagactttggtcttggtgcggcacaagccagacctactttggcagcaccgccaagaaaagccccaccagcttttgctgcgagtggggaggacaggctcaccggcagagaaataccggaatggaaatcctgctgtggattctgctcaagatggaaattcagatcttcaagatttgcctgggcgagatgcagctgtgcacctacacaccccacatctgcagacacacctgtagaggcggacctagcgccagcgatagatgctgtagctgtagccctagcggcttcagcgccggaagaggcagatgtccagttcagggatgtctgcggcctcacagagtgcagctgctgagaagatggggccctggatctcctgctggccagagactgtctaagggctttcagctgctccgttggtggggaccaggatctccagctcctgagcctagaaagggcccatttccaccacctgatcctccatggcctgtgaccgctgtgacagtgatggctggctctgtgcctagcgctcagtctgtggatgctctggaaagccctggacctctggcactggaaggacctagcagccccagaaacctgctctggcgggaaatgagcatcttcctgcctggcatcttcacctctcggattctgaacctgcaagtgctgaagaagatcctgcggagctttatgaagctgtaccactctctggtcatgtgcctgcggctgcggaccaagctggaaaaagctctgagcgctctgttcatctggccccagcacagctacaagcagaggcctcctctgcagcctgtgcaggtcgtgctcagactgggaaacctgcctccattcttcagaggcagcgaggtgccctttcctagaccttgccggaccaagatgctgaaccagaagtgtctggcccctttcatcacacacccattcgcctctcagcccctgggacaagagatgcccaacaacacccagatcagactgctgaagcccctgctgacccctgacaccagatggatcttctccaaccagctgcagacagtccagatgctctgtctgccacctctgaagcagggcgagagaatcatttggcccctcggcggctttcagatccccaacttcttttggagcctcggaatcggccacactggcgcctggtggcatactggaaggcggagaagagaatggggcggctccaccgtgtctagaagcccactgtggatcagctccatgatctacctgagaggcatggccttcgccagcgacagctccatcagaaccaccagagtgtcctggtgcagaagatgcggcgccaaatctgccgctgcctccagcctcaagaagaaaccccgggacatctgtcggatcagcgactctaagaagatgacccagaagcgcgagagcaccctgggcaatttctggatgaagctcctccagctgccagacaagaagaagaagtctaccgaaaagaccaagatcatcaagaagatgaagaaacggatcatggtccacatgtgcagctccctggctctgccaacaggcctgacatctctgatcctgccaagcagcgatctggccgtgctgatctctagctccaccagccactttctgatgcggagcccagtgctgcctagctccagactgacttgtgcctctccacagctgcccagaatgtggacctggtccagctggctgaagtggctgaaaaactggaagcggttcaagcttaaaaagaagtacatcctggccatgacgctgaccctgaacgggcatccaagaaccgcctctatcaccctgcctaccaccagcctgaagggctctagaaccagctgttgccccagatctcaccccagactgcctaggacaaagtggcctctgcagtgcctgctgcacagcctgggaacaactggaacactcgtgtgggaaaggggcgtgctgcagatgagaagtctggaagctcactgccctctgcagaccttccacctccaccactgtagaactcagcccagctcttgccctcctgcatggattctgtaccaaggacagtggagcggagccgtcgtgggacttagacctgtggctcaccatctgccaagacctattcagggcctgcactgcccacaggctccacatcaaccagctctgtcttggggcaagtggcccgtgggaatgacaggacctgccagatgttgccggtggcctagacgggaactcaaaaagaatctgctgctcccctgccggtgcagacgcgagtatagagtgacaatgggccaagccttcggcagctttagcgccgactttagcgctccccaggtgttgaagaagaatcggaagcagaacaagattatctgcaagggccaccgcatcacaagcctgatcctgagctttcagcgcgtgaaacttaagaagaaagtcaacgcctgctctcccgcctgcacctctaaagcctggactcccagaaagctcgtggggagagccgtcagaagaaagggcatcatctgtatcaagaatatgttcctgcagcggaagggtttcctgaacctgagccacgtggaaaagttcgtgcctccttctcctcctctggctctcggccctagaatgcagctctgtacccagctggcccggttcttccctatcacacctcctgtgtggcacatcctgggacctcagaggcacaccccttgtcaaaagaaggtgccctccgctagcccatggggccttagaccatctccttgcctgagctggtcctccagaattgtggcccctggacacgccctgagctgtcggactagaagaagatggtccagcaag

SEQ ID NO: 1104 - protein, 29 aa, Artificial Sequence
  hTPA amino acid sequence
MDAMKRGLCCVLLLCGAVFVSPSQEIHAR

SEQ ID NO: 1105 - protein, 232 aa, Artificial Sequence
  Human Invariant chain (hINV) amino acid sequence
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 1106 - protein, 11 aa, Artificial Sequence
  HA tag amino acid sequence
GYPYDVPDYAS

SEQ ID NO: 1107 - protein, 1547 aa, Artificial Sequence
  hTPA- and HA-extended poly-FSP polypeptide 1A
MDAMKRGLCCVLLLCGAVFVSPSQEIHARTEIQLTMNDSKHKLESPALKQVSPASPPTQQPQTPQDSRQVLALAKKTLTNASRAGQFPVWRRTSRGMSLQWKSGNACTPLRCPSRSPATFLTALNGWHRSGLRAQMPSSWSSSGRTLKLAPLQVTTTLKLILVMLEIVTERSLLYSRMCLVQIPTHTWEPDYFVSLPMMFSWATQSFPVGAVFLTRPAIPCCSCTSHSNPWSQSNQQLKWTPHILKSASFDKKGFVILSRRSKIEASPIGSIASSPGHPLGPTLAIRFISAPQPSSSTVTAAPSGQYFIAKKRIKLRRNNMGGNRSICLTRKRKREKRSQKSRQNHLQLKSCRRKISNWSKLRSPWIFTKCEICVKNTAILAITLITPQDPHLDPVCHPHRRPGWKGHHRVVFSHHPSGSTKSHWQQRERGGGRREKKGCREQRKVVKNPSQPVPLRNDGITNGNDSTRSCSISLKKSLEKMPLMRRARPTSCSTCRMWWKGKKRRKEIVPMSLACSITVSFVGQISTLVLDVSSISHWRLPCKVTESSSSFFYTSDRTPLSISRPTSRARQSCCLPGLTHPAHQPLGSMSTRREMPSQATPSPPGPWRAALGKEVKRSQSKLRLRNTSPGEKNDLQLFVMSDTTYKIYWTVILLNPCGNLHLKTTSLQRPPRSILSLNGIWEVMPRTLEGCISVKDHRTSQNHSKCITECVRTALNVSKKRLPKLMKKKDSTIFINKVRQNFKRNFKKKKPLTFSPSRRMTRRTMTTTKMMMMRRTKRRRRKRRRMTMMTRRTLLTKKTCLTPRTSAATKALPRQTISQRRPIQTPPGTSLAIWGRTRLTLTGTRSSGTRASPSAVCLCCWTCPSRSFPAASPSGLRAPVGAQAPPEVTLRASCASSASKACAGLWPWGAQVRVGAGTGGGPACVPVAEASTGAWTAEGAAGTRCRASRAPCRQLPASSPTKCEICVKRRRRRKRSSQSRSPVPKKRERMMLPVRARTARSALPQGRAPLEGMLLPRALPSLLSRMPARRESRFWLALQALGLRPPHLPSCHPLPQLLGPPPPHQAPMTLKALVKTWTQFRNYPRADKKNVRSTAFFLLDIILGDCPRTMAGPSASLHPASGRASRKTWQRRLRACRAGGPAGWARQAYPRLKTFGVPLGSILCLAGSLSTMMIISTTRQECGRRASVPCRPMIGSARPGPWRTSAMPSAMGVALPTSCESGRSPPATGGRMPGSQSIMMSWMPPLAPCAACPCSPAPTLCPAHPARAPTAVPAFTPLSAHPVPVLSGCHLAVRTSMLTLLPMEAKKSMKRSNAKKMEDMIWESRLPLRPQRGPRPLHRWLQQTTGCSQRRIVFFLAPYFPRHPHRSPPTSCPPLLEAFPLPRASLRATVPRHSSVLATGLHLHRQISLPLRGFLLHQPLPGQHLWLSHRLRLRLPRTQPSLPGPCASLLSTLSQPPPQAPSQVWTAATLRCPAVPAAACPPALRSMPKSRNQVLFRRNLTPSQLRTLAPPYMLLPQSLSQSLSRKQIPSQSMLVGYPYDVPDYAS

SEQ ID NO: 1108 - protein, 1541 aa, Artificial Sequence
  hTPA- and HA-extended poly-FSP polypeptide 2A
MDAMKRGLCCVLLLCGAVFVSPSQEIHARRKMQSLNHPSRLTNGSPPLHLCQPLRMSRTPPRRVCAAPPHRLLGPSRWNPRRKTWKMRKKYAQKPSQKNHLYGGKKRSKFSRSHLDFSPYWMKKVKVLFKADQSESSLSSGRCSLMEQIPHLKSRRKWQIRHVLKNLWLPMRSLGEPWRAGFQWGESPWQVMASLTGRATFLLALWECSLPQARLCLIVSRTLLLVQSRNKKTKLWFSLINIHHRKNPLLPMRWWCTRGGGKRKKKMCKVSGGCTACVERCPWKGICWKWPVTVAAIRMCALSHPSFYISSTVCFLSKHCMTACTRKRMKTGAIQEKGAIQEKGAMTKRICVVNFEACREMESLSAPEKITLFEAHMARCTSINVLCVRASLIEKLMKEKRKMKRNQVASPQIMQRLFIKGYQNNHFTFHLQNFAFFSSFGNNKYINILTILFHVRNIVYGIQVMLCASPQIMQRTSADRFRMKRRMQNLDNLGVPWPLLPGIPSLNAQWMFLRIASPQIMQRMSAVNFETIRARNRNMKKTMSHLIAHQALKMSGLRLFHPRLLTRKKPGKLLLAHMYGFSTYGTQKGECVCLQCLSGSSLFILKQPLDLKISKTFMGHREGSESDNLGLLYSFPPPYPISEGLTMTTGRNINSNSLMTNCLFSPIFLCHHAIMHRKMTSPHFRLFSSKIPHPQVPSVVALCKFRAFIHTPRSPGCSVYANMCWPKFFLTFSQQWSSVTSLEWTAQERGCSSWLMKQTWMKSWSLRDPSYRSILEYVSTRVLWMPTSTVLQAHPQVPALAPQAWWPARRGPLTSAPSAQQSLTREKIINPTISCPFQSPTKRLIYPPSTCSLPCRGFLPSRFPWGPPPLNSVIVHKIVLVFLKSLSSYNCERRISGIQKRAIEFAVLKLLNMDLPLENTQIPRTSPLWKITMVLTYPNCVVHVLMFGALRATAPATAAPQAQTPHWRAATTSSMSSSPRAEPTSSSSWATCWPRCCSSSCYWSLSSWPPAGAAEATNTRTRSRESQRGRMLTWRSSLWLQGTRCFTGVRTSSRYKKRGVIAWRRQINRRKLQRKKHWNSAYLGRTLLVTCILYHRWIVTSMCQSQRWLTSTTSRSSALMWTELSLEPWIPYLHQQKTQRTLESAGLFPWLHTQCQEKKSRKLMSSCTHPCTMLLPQGCHPAWLSPISACPRLLPYPFHVLALEVTFPPGTAMPQMQLQALAMWEKGWDKPGTSLQCYLNRRRNSRKQSQVQLAIQVLLVDKHKYFLFGQKKGHMIFSLANGLWFNLIFNSRKKLLEDMKQNGFTGKGLTHPVPLKRTLQNKRNKNIKRVNQKKGNIKRKSILLHLIVLNSPESNLILIQHGGIFTFRFWVEKLSWNICKNLSLYLDKFVQRLLYVYIIETNVFVLNLFHVPVNQIFMMAFYLKYTEKAWVMELEWLIQQQCYQGSCGRACSCGRGCGTPRGDWKRHPPRRAFWKPPSQGISSCLMTGCWLEKKATWMRRTRRKKREDHCGLRHPSWPWTRCLRMRPPRSGYPYDVPDYAS

SEQ ID NO: 1109 - protein, 1546 aa, Artificial Sequence
  hTPA- and HA-extended poly-FSP polypeptide 3A
MDAMKRGLCCVLLLCGAVFVSPSQEIHARGAAAASCQSPPSPRETTPSSDATRRTRPIAAQSKKTMTAAGLTPMIRKIQKRRRTANRCLRVRCGGWLCGWTPRGQNTRSTNLEKNPSLKKQSQRRGKLSSLFFSHCLCRNSRRATPTSKGSLRRKYLRVPIPPHLRHPLLLMDLDGMLTVIGQGLVGMTPRDLGTVAGATAQIQRPIQVQTGGRLTPPPLILWPQAAPVDPPGSVWILPCKNKKRRKLRPKRLDFHPRSSSGVSVITMKLWEKHFKGLNWNLVVWILNLKMMNIEITPQRSKARKSGVMKCWDLCPSEKKRKLPLPLTFSTLLWDSRHRGASSSTSRDSRSFFTSAHPSRPCRMRLYQFLIHLRKVDTHHLQVVTKTVTATTADGQRMRRLKCKACRLRWARPEPAAQAPPKSHFPPHPSGPSRTSSLQLRSIPHVPKATAAHSVTVKLQKGKNSPCCQKKLRVQNQGHLLMILLHNTYMEMHYGHQAPQVAMLPKLLCRQMLPTLSTLQQRHPQGPCPPPVTPLRVQSVLLLGVPQTAARQPSRPTGRTPTTRLMAPVGSVMSCSLLTQPSPASACTMPPLLHPQWAPHSAGLSPGACRPACTCISMTTISRATWQVSVYSGNLLSFSRRGMKSSVRLKNSRRNRRYRKIYGELKMSLQAVAPRCPRSAVDISPGPTSPSLASCASVAIGKLALLGASAPCGAAGAREAGRFAVLGTMVMKHLNRKLHLTRSCLIDLTMMMSQKLWKNQRKRIPLPSPRQHLLPQYPLHPPPPCLLLLHHRHHLAFLEMACSSQHTHSIKIWISFSHEQSSPFLARSWNTMQWNNKKMAMTVIAGAHHCQYKLTYTKVWKMNWKKMMIGSQHLLFSPLDSSPLQLLLHPHGKRCNPCCRLTWMSMLQKQCCYNLVIKHPLIFRINLRRQGKTKDGVVQSLGFLNQQIILQKEFFICLLMFIKRWKPAATKREWEKRKQILGGGGKYKEYFLKRILIRKAMTVLAGDKKGLGRFMRCVQSETKAVSLQLPLGRGPVYYVCNRMNVSSVLKPFLFTVPIEDMRECTLGRNRMNVSSVLKPCLIPVPIDLPRMLPISSPLHRPQMPFWTCTFPATTWGTWETPSTWGWRTFRGPRRKVLMVLWLPANQSLQKSQVFQWVLRTENIRKLIWTKQRSFLSLFPKLRATEQMTNVGCAFSGRILHQPEMAAMRLMPKFLNSTNSWWTCTNLSVPMMLTILIWKRVFILLLSDKKLLKKSSQLRRSWRNVSRISHQMKCLTAVDCLQAFWDMNMEHRLTMDSALSLTKREGPETCKKKLLLKLLTMSLSNILMKFRLRLRIPSLRKYRQHLKKTSAKGEKLKHCFKAWGRGPPLHTRSQKKDPAGKLKKLTTLSFVLIEERRNLQRNLKVLWLKKSTKSRYLFFLTVCGFFEKKRPEWLSSRKKGHTKNRRKAKRKPQIVHKKRGLFLKKKYLVQGAKKITFLSNGMEACGTHPTPRLSDRVFLVKITTTTSSPRRSPALRARGGTTIGEVTSLCFFYLLYGYPYDVPDYAS

SEQ ID NO: 1110 - protein, 1547 aa, Artificial Sequence
  HTPA- AND HA-EXTENDED POLY-FSP POLYPEPTIDE 4A
MDAMKRGLCCVLLLCGAVFVSPSQEIHARIQKKKQKSMAKKSQQPLVLKKNRKQEWGGQAHRQRNNAKKMPFQEEKKNGRISSSLILSFQRVKDSKKMTQKMCSSLALPTGLTSLILPSSDLAVLISSSTSHFLMRSPVLPSSRLTCASPQLPRMWTWSSWLKHPRTASITLPTTSLKGSRTSCCPRSHPRLPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRRSQKSQHHCALRKIEWATKLSLGGKAGPQAQEKARPSPCLSWSSRIVAPGHALSCRTRRRWSSKCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIFCQKKVPSASPWGLVPPSPPLALGPRMQLCTQLARFFPITPPVWHILGPQRHTPQVVLRLGNLPPFFRGSEVPFPRPCRTKNEGNNHWPRVEMPTGWLLVGYNTRNTAQNPRLQQHLKHWQQCTRARWCQEPCQTLTFFHFFFFFKTVSLCCPGWSKGQPPPPGLKPSSLASQVARTTGVYQHVWLICFVFFVCVETGFCHVAQVGLERLVSLSGITDVNHWAQPKPSPSKGTGMNRPIGLRVGKGVWARLLKKKPRDICRISNRKTRKAAREKHRKTDRASVSFWTLLPTTGVRTRGSPLRLTLWPPRCRCRREYRVTMNILNSLPSSMEIAVLQETAKKSPTSFCCNLDLQHQRRRKKKKDKVEIRNRSPKANSTECQGEHSREQNLLNLVQLNPHSPHHRKDEEDHQKRHHHHNQKKMSVPLFFHGDLCRESTLGNFWMKLLQLPQRPPLQPVTGMEILLWILLKMEIQIFKICLGEMQLCTSRILNLQVLKKILRSFMKLYHSLVMCLRLRTKLEKALSALFIWPQHSYKITHPFASQPLGQEMPNNTQIRLLKPDKKKKSTEKTKGQAFGSFSADFSAPQGQAFGSLCQLVSADFSAPQVTRLRSLNHLLIWLKNWKRFKLKKKYQAPLRLWSWCGTSQTYFGSIICIKNMFLQRKGFLNLSHVEKFELKKNLLLPVVINLKRLQKFMLNQKCLAPFPACTSKAWTPRKLVGRAVRRKGILAMTLTLNGIEALTALFTCRTASISVNISTLMSILEAIIKKMKKRIMVHRWIFSNQLTVQMLCLPLLTPDTRWIFSNQLQTVQMLCLPPLKQGERIIWPLGGFQIPNFFWSLGIGHTGAWWHTGRRRREWGGSTVSRSPLWISSMIYLRGMAFASDSSIRTTRVSWCRRCGAKSAAASSSPLWDCSTTTGTHHGCLWEIPSVTLLANLHLCYYHSQSNRNKSRQMESLGMKLQLKKKVNACSTYTPHICRHTCRVNAVEELHSRRMSVRIVKNWVSCCYVRLSAVGLSTWSALDNKIICKGHRITGYPYDVPDYAS

SEQ ID NO: 1111 - protein, 1547 aa, Artificial Sequence
  hTPA- and HA-extended poly-FSP polypeptide 1B
MDAMKRGLCCVLLLCGAVFVSPSQEIHARTEIQLTMNDSKHKLESPALKQVSPASPPTQQPQTPQDSRQVLAMPSSWSSSGRTQRKVVKNPSQPVPLRNDGITNGNDSTRSCSISLKKSLEKMPLMMKKKDSTIFIVPMSLACSITVSFVGQISTLVLDVSSISHWNKVRQNFKRNADKKNVRSGEKNDLQLFVMSDTTYKIYWTVILLNPCGNLHLKTTSLGDCPRTMAGPSASLHPASGRASRKTWQRRLRACRAGGPAGWARQAFDKKGFVILSVGAGTGGGPACVPVAEASTGAWTAEGAAGTRCRASRAPCRQLPASSPTKCEICVKRRRRRKRSSQSRSPVPKKRERMMLPVRARTARSALPQGRAPLEGMLLPRALPSLLSRMPARRESRFWLALQALGLRPPHLPSCHPLPQLLGPPPPHQAPTAFFLLDIILRLPCKVTESSNMGGNRSICLTNAKKMEDMIWESTPLSISRPTSRARQSCCLPGLTHPAHQPLGSMTLAIRFISAPQPSSSTVTAAPSGQYFKGKKRRKEIFKKKKPLTFSPSLAKKTLTNSSFFYTSDREAKKSMKRSMTLKALVKTWTQFRNYPRASSPGHPLGPNGIWEVMPRTLEGCISVKDHRTSQNHSKCITECVRTALNRRSKIEASPIGSIALRSMPKSRNQVLFRRNLTPSQLRTLAPPYMLLPQSLSQSLSRKQIPSQSMLVASRAGQFPVWRRTSRGMSLQWKSGNACTPLRCPSRSPATFLTALNGWHRSGLRAQRKRKREKRSQKSRQNHLQLKSCRRKISNWSKLRSPWIFVSKKRLPKLTKCEICVKNTAILAITLITPQDPHLDPVCHPHRRPGWKGHHRVVFSHHPSGSTKSHWQQRERGGGRREKKGCRERSLLYSRMCLVQIPTHTWEPDYFVSLPMMFSWATQSFPVGAVFLTRPAIPCCSCTSHSNPWSQSRHPHRSPPTSCPPLLEAFPLPRASLRATVPRHSSVLATGLHLHRQISLPLRGFLLHQPLPGQHLWLSHRLRLRLPRTQRPPRSILSLRLPLRPQRGPRPLHRWLQQTTGCSQRRYPRLKTFGVPLGSILCLAGSLSTMMIISTTRQECGRRASVPCRPMIGSARPGPWRTSAMPSAMGVALPTSCESGRSPPATGGRMPGSQSIMMSWMPPLAPCAACPCSPAPTLCPAHPARAPTAVPAFTPLSAHPVPVLSGCHLAVRTSMLTLLPMLKLAPLQVTTTLKLILVMLEIVTESTRREMPSQATPSPPGPWRAALGKEVKRSQSKLRLRNTSPIVFFLAPYFPRRMTRRTMTTTKMMMMRRTKRRRRKRRRMTMMTRRTLLTKKTCLTPRTSAATKALPRQTISQRRPIQTPPGTSLAIWGNQQLKWTPHILKSASRRARPTSCSTCRMWWIAKKRIKLRRNRTRLTLTGTRSSGTRASPSAVCLCCWTCPSRSFPAASPSGLRAPVGAQAPPEVTLRASCASSASKACAGLWPWGAQVRQPSLPGPCASLLSTLSQPPPQAPSQVWTAATLRCPAVPAAACPPGYPYDVPDYAS

SEQ ID NO: 1112 - protein, 1541 aa, Artificial Sequence
  hTPA- and HA-extended poly-FSP polypeptide 2B
MDAMKRGLCCVLLLCGAVFVSPSQEIHARRKMQSLNHPSRLTNMSRTPPRRVCNPRRKTWKMRKKYAQKPSQKNHLYNSRKKLLEDMKQNGFTGHREGSESDNLGLLYSFPPIRMCALSHPSFYISSTVCFLSKHCMTACTQKKGHMIFSREKIINPTISCPFQSPTKRLELSLEPWIPYLHQQKTQGGKKRSKFPGTSLQCYLNRCSLMEQIPHLKSASPQIMQRTSADRFRMKRRMQNLDNLGVPWPLLPGPLENTQIPRTSPLWKITMVLTYPNCVVHVLMFWLPMRSLGEPWRAGFQWGESPWQVMASLTGPYPISEGLTMTTGRNINSNSLMTNCLFSPIFLCHHAIMHRKMTSPHFRLFSSKIPHPQVPSVVALCKFRATFLLALWECSLPQARLCLIVSRTLLLVQSAAPPHRLLGPSRWSRSHLDFSPYWMKKVKLANGLWFNLIFVLFKADQSESSLSSGRNKKTKLWFSLINIHHRKNPLLPMRIPSLNAQWMFLRILLLAHMYGFSTYGTQKGECVCLQCLSGSSLFILKQPLDLKISKTFMLQAHPQVPALAPQAWWPARRGPLTSAPSAQQSLTASPQIMQRMSAVNFETIIYPPSTCSLPCRGRTLESAGLFPWLHTQCTHPCTMLLPQGWWCTRGGGKRKKKMCKVSGGCTACVERCPWKGICWKWPVTVAAQWSSVTSLEWTAQERGCSSWLMKQTWMKSWSLRDPSYRSILEYVSTRVLWMPTSTVRRRNSRKQSQVQLAIQVLLVDKHKYFLFGRARNRNMKKTMSHLIAHQALKMSGLRLFHPRLLTRKKPGKFLPSRFPWGPPPLCHPAWLSPISACPRLLPYPFHVLALEVTFPPGTAMPQMQLQALAMWEKGWDKRKRMKTGAIQEKGAIQEKGAMTKRICVVNFEACREMESLSAPEKITLFEAHMARCTSINVLCVRASLIEKLMKEKRKMKRNQVASPQIMQRLFIKGYQNNHFTFHLQNFAFFSSFGNNKYINILTRRKKREDHCGLLILIQHGGIFTFRFWVEKLSWNICKNLSLYLDKFVQRLLYVYIIETNVFVLNLFHVPVNQIFMMAFYLKYTEKAWVMELEWLIQQQCYQQEKKSRKLMSSCRAFIHTPRSPGCSVYANMCWAFWKPPSQGISSCLMTGCWGSPPLHLCQPLRRYKKRGVIAWRRRKWQIRHVLKNLILFHVRNIVYGIQVMLCGKGLTHPVPLKRTLQNKRNKNIKRVNQKKGNIKRKSILLHLIVLNSPESNPKFFLTFSQLEKKATWMRRTGALRATAPATAAPQAQTPHWRAATTSSMSSSPRAEPTSSSSWATCWPRCCSSSCYWSLSSWPPAGAAEATNTRTRSRESQRGRMLTWRSSLWLQGTRCFTGVRTSSGSCGRACSCGRGCGTPRGDWKRHPPRRNSVIVHKIVLVFLKSLSSYNCERRISGIQKRAIEFAVLKLLNMDLHWNSAYLGRTLLVTCILYHRWIVTSMCQSQRWLTSTTSRSSALMWTRQINRRKLQRKKRHPSWPWTRCLRMRPPRSGYPYDVPDYAS

SEQ ID NO: 1113 - protein, 1546 aa, Artificial Sequence
  hTPA- and HA-extended poly-FSP polypeptide 3B
MDAMKRGLCCVLLLCGAVFVSPSQEIHARGAAAASCQSPPSPRETTPSSDATRRTRPIAAQSKKTMTAAGLTPKNKKRRKLRPKMIRKIQKRRRTANRRNSRRATPTSKGSLRRKYLRVRGPPLHTRNIRKLIWTKQRSFLSLFPKLRATEQMTNVGCSIPHVPKATAAHSVTVKLQLPLTFSTLLWDSRHTMSLSNILMKFRLQSSPFLARSWNTMQWNNKKMAMTVIAGAHHCQYKLTYTKVWKMNWKKMMIGSQHLLFSPLDSSPLQLLLHPHGKRCNPCCRLTWMSQNTRSTNLEKNPSLKKQSQRRGKLSAFSGRILHQPEMAAMRLMPKFLNSTNSWWTLTTLSFVLIEEARQPSRPTGRTPTTRLMAPVGSVMSCSLLTQPSPASACTMPPLLHPQWAPHSAGLSPGACRPACTCISMTTISRATWGPVYYVCNRMNVSSVLKPFLFTVPIEDMRECTLGRNRMNVSSVLKPCLIPVPISEKKRKLPNIEITPQRSKAMLQKQCCYNLVIKHPLIFRINLRRQGKTKDGVVQSLGFLNQQIILQKEFFICLLMFIKRWKPAATKSRKKGHTKNRRKAKRKPQIYLFFLTVCGFHLKKTSAKWLKKSTKSRSNGMEACGTHPTPRLSCLRVRCGGWLCGWTPRGRKSGVMKCWDLCPVHKKRGLFRLDFHPRSSSGKGKNSPCCQKKLRVQNQGHLLMILLHNDRVFLVKIGEKLKHCFKAWGSRRNRRYRKIYGELKMSLQAFLIHLRKVDTHHLQVVTKTVTATTADGQRMRRLKCKACRLRWARPEPAAQAPPKSHFPPHPSGPSRTSSLQLRSLFFSHCLCSQKKDPAGKLKKLLKKSSQLRRSWRNVSRISTPPPLILWPQAAPVSVITMKLWEKHFKGLNWNLVVWILNLKMMTYMEMHYGHQAPQVAMLPKLLCRQMLPTLSTLQQRHPQGPCPPPVTPLRVQSVLLLGVPQTARGPRRKVLMVLWLPANQSLQKSQVFQWVLRTEVAPRCPRSAVDISPGPTSPSLASCASVAIGKLALLGASAPCGAAGAREAGRFAVLGTMVMKLCFFYLLYRLRIPSLRKYRQHLNRKLHLTRSCLIDLTMMMSQKLWKNQRKRIPLPSPRQHLLPQYPLHPPPPCLLLLHHRHHLAFLEMACSSQHTHSIKIWISFSHEVDPPGSVWILPCDLPRMLPISSPLHRPQMPFWTCTFPATTWGTWETPSTWGWRTFRGASSSTSRDSRSFFTSAHPSRPCRMRLYQCKKKLLLKLLTTTTSSPRRSPALRARGGTTIGEVTSCTNLSVPMMLTILIWKRVFILLLSDKKGAKKITFLPIPPHLRHPLLLFEKKRPEWLSMDLDGMLTVIGQGLVGMTPRDLGTVAGATAQIQRPIQVQTGGRLRRNLQRNLKVLQVSVYSGNLLSFSRRGMKSSVRLKNREWEKRKQILGGGGKYKEYFLKRILIRKAMTVLAGDKKGLGRFMRCVQSETKAVSLQLPLGRNMEHRLTMDSALSLTKREGPETLKKKYLVQHQMKCLTAVDCLQAFWDMGYPYDVPDYAS

SEQ ID NO: 1114 - protein, 1547 aa, Artificial Sequence
  hTPA- and HA-extended poly-FSP polypeptide 4B
MDAMKRGLCCVLLLCGAVFVSPSQEIHARIQKKKQKSNLDLQHQRRRKKKKDKVEIRNRSPKANSTECQGEHSREQNLLNLVQLNPHSPHHRKDEEDHQKRHHHHNQKKMSVMAKKSQQPLGQAFGSLCQLVSADFSAPQVTRLRSLNHLLINEGNNHWPRVEMPTGWLLVGYNTRNTAQNPRLQQHLKHWQQCTRARWCQEPCQTLTFFHFFFFFKTVSLCCPGWSKGQPPPPGLKPSSLASQVARTTGVYQHVWLICFVFFVCVETGFCHVAQVGLERLVSLSGITDVNHWAQPKPSPSKGTGMNRPIGLRVGKGVWARLRASVSFWTLLPTTGVRTRGSPLRLTLWPPRNILNSLPSSMEIAVLQENRKTRKAAREKHRKTDNLHLCYYHSQSNRNKSRQMESLGMKLQSPLWDCSTTTGTHHGCLWEIPSVTLLACRVNAVEELHSRRMSVRIVKNWVSCCYVRLSAVGLSTWSALDVVINLKRLQKFSQKSQHHCALRKIEWATKLSLGGKAGPQAQEKANAKKMPFQRWIFSNQLTVQMLCLPIEALTALFTCRTASISVNISTLMSILEAPLFFHGDLCEEKKNGRISSQAPLRLWSWCGTSQTYFGSTAKKSPTSFCCEWGGQAHRQRNTGMEILLWILLKMEIQIFKICLGEMQLCTYTPHICRHTCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIFTSRILNLQVLKKILRSFMKLYHSLVMCLRLRTKLEKALSALFIWPQHSYKQRPPLQPVQVVLRLGNLPPFFRGSEVPFPRPCRTKMLNQKCLAPFITHPFASQPLGQEMPNNTQIRLLKPLLTPDTRWIFSNQLQTVQMLCLPPLKQGERIIWPLGGFQIPNFFWSLGIGHTGAWWHTGRRRREWGGSTVSRSPLWISSMIYLRGMAFASDSSIRTTRVSWCRRCGAKSAAASSLKKKPRDICRISDSKKMTQKRESTLGNFWMKLLQLPDKKKKSTEKTKIIKKMKKRIMVHMCSSLALPTGLTSLILPSSDLAVLISSSTSHFLMRSPVLPSSRLTCASPQLPRMWTWSSWLKWLKNWKRFKLKKKYILAMTLTLNGHPRTASITLPTTSLKGSRTSCCPRSHPRLPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRRELKKNLLLPCRCRREYRVTMGQAFGSFSADFSAPQVLKKNRKQNKIICKGHRITSLILSFQRVKLKKKVNACSPACTSKAWTPRKLVGRAVRRKGIICIKNMFLQRKGFLNLSHVEKFVPPSPPLALGPRMQLCTQLARFFPITPPVWHILGPQRHTPCQKKVPSASPWGLRPSPCLSWSSRIVAPGHALSCRTRRRWSSKGYPYDVPDYAS

SEQ ID NO: 1115 - protein, 1750 aa, Artificial Sequence
  hINV- and HA-extended poly-FSP polypeptide 1A
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMTEIQLTMNDSKHKLESPALKQVSPASPPTQQPQTPQDSRQVLALAKKTLTNASRAGQFPVWRRTSRGMSLQWKSGNACTPLRCPSRSPATFLTALNGWHRSGLRAQMPSSWSSSGRTLKLAPLQVTTTLKLILVMLEIVTERSLLYSRMCLVQIPTHTWEPDYFVSLPMMFSWATQSFPVGAVFLTRPAIPCCSCTSHSNPWSQSNQQLKWTPHILKSASFDKKGFVILSRRSKIEASPIGSIASSPGHPLGPTLAIRFISAPQPSSSTVTAAPSGQYFIAKKRIKLRRNNMGGNRSICLTRKRKREKRSQKSRQNHLQLKSCRRKISNWSKLRSPWIFTKCEICVKNTAILAITLITPQDPHLDPVCHPHRRPGWKGHHRVVFSHHPSGSTKSHWQQRERGGGRREKKGCREQRKVVKNPSQPVPLRNDGITNGNDSTRSCSISLKKSLEKMPLMRRARPTSCSTCRMWWKGKKRRKEIVPMSLACSITVSFVGQISTLVLDVSSISHWRLPCKVTESSSSFFYTSDRTPLSISRPTSRARQSCCLPGLTHPAHQPLGSMSTRREMPSQATPSPPGPWRAALGKEVKRSQSKLRLRNTSPGEKNDLQLFVMSDTTYKIYWTVILLNPCGNLHLKTTSLQRPPRSILSLNGIWEVMPRTLEGCISVKDHRTSQNHSKCITECVRTALNVSKKRLPKLMKKKDSTIFINKVRQNFKRNFKKKKPLTFSPSRRMTRRTMTTTKMMMMRRTKRRRRKRRRMTMMTRRTLLTKKTCLTPRTSAATKALPRQTISQRRPIQTPPGTSLAIWGRTRLTLTGTRSSGTRASPSAVCLCCWTCPSRSFPAASPSGLRAPVGAQAPPEVTLRASCASSASKACAGLWPWGAQVRVGAGTGGGPACVPVAEASTGAWTAEGAAGTRCRASRAPCRQLPASSPTKCEICVKRRRRRKRSSQSRSPVPKKRERMMLPVRARTARSALPQGRAPLEGMLLPRALPSLLSRMPARRESRFWLALQALGLRPPHLPSCHPLPQLLGPPPPHQAPMTLKALVKTWTQFRNYPRADKKNVRSTAFFLLDIILGDCPRTMAGPSASLHPASGRASRKTWQRRLRACRAGGPAGWARQAYPRLKTFGVPLGSILCLAGSLSTMMIISTTRQECGRRASVPCRPMIGSARPGPWRTSAMPSAMGVALPTSCESGRSPPATGGRMPGSQSIMMSWMPPLAPCAACPCSPAPTLCPAHPARAPTAVPAFTPLSAHPVPVLSGCHLAVRTSMLTLLPMEAKKSMKRSNAKKMEDMIWESRLPLRPQRGPRPLHRWLQQTTGCSQRRIVFFLAPYFPRHPHRSPPTSCPPLLEAFPLPRASLRATVPRHSSVLATGLHLHRQISLPLRGFLLHQPLPGQHLWLSHRLRLRLPRTQPSLPGPCASLLSTLSQPPPQAPSQVWTAATLRCPAVPAAACPPALRSMPKSRNQVLFRRNLTPSQLRTLAPPYMLLPQSLSQSLSRKQIPSQSMLVGYPYDVPDYAS

SEQ ID NO: 1116 - protein, 1744 aa, Artificial Sequence
  hINV- and HA-extended poly-FSP polypeptide 2A
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMRKMQSLNHPSRLTNGSPPLHLCQPLRMSRTPPRRVCAAPPHRLLGPSRWNPRRKTWKMRKKYAQKPSQKNHLYGGKKRSKFSRSHLDFSPYWMKKVKVLFKADQSESSLSSGRCSLMEQIPHLKSRRKWQIRHVLKNLWLPMRSLGEPWRAGFQWGESPWQVMASLTGRATFLLALWECSLPQARLCLIVSRTLLLVQSRNKKTKLWFSLINIHHRKNPLLPMRWWCTRGGGKRKKKMCKVSGGCTACVERCPWKGICWKWPVTVAAIRMCALSHPSFYISSTVCFLSKHCMTACTRKRMKTGAIQEKGAIQEKGAMTKRICVVNFEACREMESLSAPEKITLFEAHMARCTSINVLCVRASLIEKLMKEKRKMKRNQVASPQIMQRLFIKGYQNNHFTFHLQNFAFFSSFGNNKYINILTILFHVRNIVYGIQVMLCASPQIMQRTSADRFRMKRRMQNLDNLGVPWPLLPGIPSLNAQWMFLRIASPQIMQRMSAVNFETIRARNRNMKKTMSHLIAHQALKMSGLRLFHPRLLTRKKPGKLLLAHMYGFSTYGTQKGECVCLQCLSGSSLFILKQPLDLKISKTFMGHREGSESDNLGLLYSFPPPYPISEGLTMTTGRNINSNSLMTNCLFSPIFLCHHAIMHRKMTSPHFRLFSSKIPHPQVPSVVALCKFRAFIHTPRSPGCSVYANMCWPKFFLTFSQQWSSVTSLEWTAQERGCSSWLMKQTWMKSWSLRDPSYRSILEYVSTRVLWMPTSTVLQAHPQVPALAPQAWWPARRGPLTSAPSAQQSLTREKIINPTISCPFQSPTKRLIYPPSTCSLPCRGFLPSRFPWGPPPLNSVIVHKIVLVFLKSLSSYNCERRISGIQKRAIEFAVLKLLNMDLPLENTQIPRTSPLWKITMVLTYPNCVVHVLMFGALRATAPATAAPQAQTPHWRAATTSSMSSSPRAEPTSSSSWATCWPRCCSSSCYWSLSSWPPAGAAEATNTRTRSRESQRGRMLTWRSSLWLQGTRCFTGVRTSSRYKKRGVIAWRRQINRRKLQRKKHWNSAYLGRTLLVTCILYHRWIVTSMCQSQRWLTSTTSRSSALMWTELSLEPWIPYLHQQKTQRTLESAGLFPWLHTQCQEKKSRKLMSSCTHPCTMLLPQGCHPAWLSPISACPRLLPYPFHVLALEVTFPPGTAMPQMQLQALAMWEKGWDKPGTSLQCYLNRRRNSRKQSQVQLAIQVLLVDKHKYFLFGQKKGHMIFSLANGLWFNLIFNSRKKLLEDMKQNGFTGKGLTHPVPLKRTLQNKRNKNIKRVNQKKGNIKRKSILLHLIVLNSPESNLILIQHGGIFTFRFWVEKLSWNICKNLSLYLDKFVQRLLYVYIIETNVFVLNLFHVPVNQIFMMAFYLKYTEKAWVMELEWLIQQQCYQGSCGRACSCGRGCGTPRGDWKRHPPRRAFWKPPSQGISSCLMTGCWLEKKATWMRRTRRKKREDHCGLRHPSWPWTRCLRMRPPRSGYPYDVPDYAS

SEQ ID NO: 1117 - protein, 1749 aa, Artificial Sequence
  hINV- and HA-extended poly-FSP polypeptide 3A
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMGAAAASCQSPPSPRETTPSSDATRRTRPIAAQSKKTMTAAGLTPMIRKIQKRRRTANRCLRVRCGGWLCGWTPRGQNTRSTNLEKNPSLKKQSQRRGKLSSLFFSHCLCRNSRRATPTSKGSLRRKYLRVPIPPHLRHPLLLMDLDGMLTVIGQGLVGMTPRDLGTVAGATAQIQRPIQVQTGGRLTPPPLILWPQAAPVDPPGSVWILPCKNKKRRKLRPKRLDFHPRSSSGVSVITMKLWEKHFKGLNWNLVVWILNLKMMNIEITPQRSKARKSGVMKCWDLCPSEKKRKLPLPLTFSTLLWDSRHRGASSSTSRDSRSFFTSAHPSRPCRMRLYQFLIHLRKVDTHHLQVVTKTVTATTADGQRMRRLKCKACRLRWARPEPAAQAPPKSHFPPHPSGPSRTSSLQLRSIPHVPKATAAHSVTVKLQKGKNSPCCQKKLRVQNQGHLLMILLHNTYMEMHYGHQAPQVAMLPKLLCRQMLPTLSTLQQRHPQGPCPPPVTPLRVQSVLLLGVPQTAARQPSRPTGRTPTTRLMAPVGSVMSCSLLTQPSPASACTMPPLLHPQWAPHSAGLSPGACRPACTCISMTTISRATWQVSVYSGNLLSFSRRGMKSSVRLKNSRRNRRYRKIYGELKMSLQAVAPRCPRSAVDISPGPTSPSLASCASVAIGKLALLGASAPCGAAGAREAGRFAVLGTMVMKHLNRKLHLTRSCLIDLTMMMSQKLWKNQRKRIPLPSPRQHLLPQYPLHPPPPCLLLLHHRHHLAFLEMACSSQHTHSIKIWISFSHEQSSPFLARSWNTMQWNNKKMAMTVIAGAHHCQYKLTYTKVWKMNWKKMMIGSQHLLFSPLDSSPLQLLLHPHGKRCNPCCRLTWMSMLQKQCCYNLVIKHPLIFRINLRRQGKTKDGVVQSLGFLNQQIILQKEFFICLLMFIKRWKPAATKREWEKRKQILGGGGKYKEYFLKRILIRKAMTVLAGDKKGLGRFMRCVQSETKAVSLQLPLGRGPVYYVCNRMNVSSVLKPFLFTVPIEDMRECTLGRNRMNVSSVLKPCLIPVPIDLPRMLPISSPLHRPQMPFWTCTFPATTWGTWETPSTWGWRTFRGPRRKVLMVLWLPANQSLQKSQVFQWVLRTENIRKLIWTKQRSFLSLFPKLRATEQMTNVGCAFSGRILHQPEMAAMRLMPKFLNSTNSWWTCTNLSVPMMLTILIWKRVFILLLSDKKLLKKSSQLRRSWRNVSRISHQMKCLTAVDCLQAFWDMNMEHRLTMDSALSLTKREGPETCKKKLLLKLLTMSLSNILMKFRLRLRIPSLRKYRQHLKKTSAKGEKLKHCFKAWGRGPPLHTRSQKKDPAGKLKKLTTLSFVLIEERRNLQRNLKVLWLKKSTKSRYLFFLTVCGFFEKKRPEWLSSRKKGHTKNRRKAKRKPQIVHKKRGLFLKKKYLVQGAKKITFLSNGMEACGTHPTPRLSDRVFLVKITTTTSSPRRSPALRARGGTTIGEVTSLCFFYLLYGYPYDVPDYAS

SEQ ID NO: 1118 - protein, 1750 aa, Artificial Sequence
  hINV- and HA-extended poly-FSP polypeptide 4A
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMIQKKKQKSMAKKSQQPLVLKKNRKQEWGGQAHRQRNNAKKMPFQEEKKNGRISSSLILSFQRVKDSKKMTQKMCSSLALPTGLTSLILPSSDLAVLISSSTSHFLMRSPVLPSSRLTCASPQLPRMWTWSSWLKHPRTASITLPTTSLKGSRTSCCPRSHPRLPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRRSQKSQHHCALRKIEWATKLSLGGKAGPQAQEKARPSPCLSWSSRIVAPGHALSCRTRRRWSSKCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIFCQKKVPSASPWGLVPPSPPLALGPRMQLCTQLARFFPITPPVWHILGPQRHTPQVVLRLGNLPPFFRGSEVPFPRPCRTKNEGNNHWPRVEMPTGWLLVGYNTRNTAQNPRLQQHLKHWQQCTRARWCQEPCQTLTFFHFFFFFKTVSLCCPGWSKGQPPPPGLKPSSLASQVARTTGVYQHVWLICFVFFVCVETGFCHVAQVGLERLVSLSGITDVNHWAQPKPSPSKGTGMNRPIGLRVGKGVWARLLKKKPRDICRISNRKTRKAAREKHRKTDRASVSFWTLLPTTGVRTRGSPLRLTLWPPRCRCRREYRVTMNILNSLPSSMEIAVLQETAKKSPTSFCCNLDLQHQRRRKKKKDKVEIRNRSPKANSTECQGEHSREQNLLNLVQLNPHSPHHRKDEEDHQKRHHHHNQKKMSVPLFFHGDLCRESTLGNFWMKLLQLPQRPPLQPVTGMEILLWILLKMEIQIFKICLGEMQLCTSRILNLQVLKKILRSFMKLYHSLVMCLRLRTKLEKALSALFIWPQHSYKITHPFASQPLGQEMPNNTQIRLLKPDKKKKSTEKTKGQAFGSFSADFSAPQGQAFGSLCQLVSADFSAPQVTRLRSLNHLLIWLKNWKRFKLKKKYQAPLRLWSWCGTSQTYFGSIICIKNMFLQRKGFLNLSHVEKFELKKNLLLPVVINLKRLQKFMLNQKCLAPFPACTSKAWTPRKLVGRAVRRKGILAMTLTLNGIEALTALFTCRTASISVNISTLMSILEAIIKKMKKRIMVHRWIFSNQLTVQMLCLPLLTPDTRWIFSNQLQTVQMLCLPPLKQGERIIWPLGGFQIPNFFWSLGIGHTGAWWHTGRRRREWGGSTVSRSPLWISSMIYLRGMAFASDSSIRTTRVSWCRRCGAKSAAASSSPLWDCSTTTGTHHGCLWEIPSVTLLANLHLCYYHSQSNRNKSRQMESLGMKLQLKKKVNACSTYTPHICRHTCRVNAVEELHSRRMSVRIVKNWVSCCYVRLSAVGLSTWSALDNKIICKGHRITGYPYDVPDYAS

SEQ ID NO: 1119 - protein, 1750 aa, Artificial Sequence
  hINV- and HA-extended poly-FSP polypeptide 1B
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMTEIQLTMNDSKHKLESPALKQVSPASPPTQQPQTPQDSRQVLAMPSSWSSSGRTQRKVVKNPSQPVPLRNDGITNGNDSTRSCSISLKKSLEKMPLMMKKKDSTIFIVPMSLACSITVSFVGQISTLVLDVSSISHWNKVRQNFKRNADKKNVRSGEKNDLQLFVMSDTTYKIYWTVILLNPCGNLHLKTTSLGDCPRTMAGPSASLHPASGRASRKTWQRRLRACRAGGPAGWARQAFDKKGFVILSVGAGTGGGPACVPVAEASTGAWTAEGAAGTRCRASRAPCRQLPASSPTKCEICVKRRRRRKRSSQSRSPVPKKRERMMLPVRARTARSALPQGRAPLEGMLLPRALPSLLSRMPARRESRFWLALQALGLRPPHLPSCHPLPQLLGPPPPHQAPTAFFLLDIILRLPCKVTESSNMGGNRSICLTNAKKMEDMIWESTPLSISRPTSRARQSCCLPGLTHPAHQPLGSMTLAIRFISAPQPSSSTVTAAPSGQYFKGKKRRKEIFKKKKPLTFSPSLAKKTLTNSSFFYTSDREAKKSMKRSMTLKALVKTWTQFRNYPRASSPGHPLGPNGIWEVMPRTLEGCISVKDHRTSQNHSKCITECVRTALNRRSKIEASPIGSIALRSMPKSRNQVLFRRNLTPSQLRTLAPPYMLLPQSLSQSLSRKQIPSQSMLVASRAGQFPVWRRTSRGMSLQWKSGNACTPLRCPSRSPATFLTALNGWHRSGLRAQRKRKREKRSQKSRQNHLQLKSCRRKISNWSKLRSPWIFVSKKRLPKLTKCEICVKNTAILAITLITPQDPHLDPVCHPHRRPGWKGHHRVVFSHHPSGSTKSHWQQRERGGGRREKKGCRERSLLYSRMCLVQIPTHTWEPDYFVSLPMMFSWATQSFPVGAVFLTRPAIPCCSCTSHSNPWSQSRHPHRSPPTSCPPLLEAFPLPRASLRATVPRHSSVLATGLHLHRQISLPLRGFLLHQPLPGQHLWLSHRLRLRLPRTQRPPRSILSLRLPLRPQRGPRPLHRWLQQTTGCSQRRYPRLKTFGVPLGSILCLAGSLSTMMIISTTRQECGRRASVPCRPMIGSARPGPWRTSAMPSAMGVALPTSCESGRSPPATGGRMPGSQSIMMSWMPPLAPCAACPCSPAPTLCPAHPARAPTAVPAFTPLSAHPVPVLSGCHLAVRTSMLTLLPMLKLAPLQVTTTLKLILVMLEIVTESTRREMPSQATPSPPGPWRAALGKEVKRSQSKLRLRNTSPIVFFLAPYFPRRMTRRTMTTTKMMMMRRTKRRRRKRRRMTMMTRRTLLTKKTCLTPRTSAATKALPRQTISQRRPIQTPPGTSLAIWGNQQLKWTPHILKSASRRARPTSCSTCRMWWIAKKRIKLRRNRTRLTLTGTRSSGTRASPSAVCLCCWTCPSRSFPAASPSGLRAPVGAQAPPEVTLRASCASSASKACAGLWPWGAQVRQPSLPGPCASLLSTLSQPPPQAPSQVWTAATLRCPAVPAAACPPGYPYDVPDYAS

SEQ ID NO: 1120 - protein, 1744 aa, Artificial Sequence
  hINV- and HA-extended poly-FSP polypeptide 2B
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMRKMQSLNHPSRLTNMSRTPPRRVCNPRRKTWKMRKKYAQKPSQKNHLYNSRKKLLEDMKQNGFTGHREGSESDNLGLLYSFPPIRMCALSHPSFYISSTVCFLSKHCMTACTQKKGHMIFSREKIINPTISCPFQSPTKRLELSLEPWIPYLHQQKTQGGKKRSKFPGTSLQCYLNRCSLMEQIPHLKSASPQIMQRTSADRFRMKRRMQNLDNLGVPWPLLPGPLENTQIPRTSPLWKITMVLTYPNCVVHVLMFWLPMRSLGEPWRAGFQWGESPWQVMASLTGPYPISEGLTMTTGRNINSNSLMTNCLFSPIFLCHHAIMHRKMTSPHFRLFSSKIPHPQVPSVVALCKFRATFLLALWECSLPQARLCLIVSRTLLLVQSAAPPHRLLGPSRWSRSHLDFSPYWMKKVKLANGLWFNLIFVLFKADQSESSLSSGRNKKTKLWFSLINIHHRKNPLLPMRIPSLNAQWMFLRILLLAHMYGFSTYGTQKGECVCLQCLSGSSLFILKQPLDLKISKTFMLQAHPQVPALAPQAWWPARRGPLTSAPSAQQSLTASPQIMQRMSAVNFETIIYPPSTCSLPCRGRTLESAGLFPWLHTQCTHPCTMLLPQGWWCTRGGGKRKKKMCKVSGGCTACVERCPWKGICWKWPVTVAAQWSSVTSLEWTAQERGCSSWLMKQTWMKSWSLRDPSYRSILEYVSTRVLWMPTSTVRRRNSRKQSQVQLAIQVLLVDKHKYFLFGRARNRNMKKTMSHLIAHQALKMSGLRLFHPRLLTRKKPGKFLPSRFPWGPPPLCHPAWLSPISACPRLLPYPFHVLALEVTFPPGTAMPQMQLQALAMWEKGWDKRKRMKTGAIQEKGAIQEKGAMTKRICVVNFEACREMESLSAPEKITLFEAHMARCTSINVLCVRASLIEKLMKEKRKMKRNQVASPQIMQRLFIKGYQNNHFTFHLQNFAFFSSFGNNKYINILTRRKKREDHCGLLILIQHGGIFTFRFWVEKLSWNICKNLSLYLDKFVQRLLYVYIIETNVFVLNLFHVPVNQIFMMAFYLKYTEKAWVMELEWLIQQQCYQQEKKSRKLMSSCRAFIHTPRSPGCSVYANMCWAFWKPPSQGISSCLMTGCWGSPPLHLCQPLRRYKKRGVIAWRRRKWQIRHVLKNLILFHVRNIVYGIQVMLCGKGLTHPVPLKRTLQNKRNKNIKRVNQKKGNIKRKSILLHLIVLNSPESNPKFFLTFSQLEKKATWMRRTGALRATAPATAAPQAQTPHWRAATTSSMSSSPRAEPTSSSSWATCWPRCCSSSCYWSLSSWPPAGAAEATNTRTRSRESQRGRMLTWRSSLWLQGTRCFTGVRTSSGSCGRACSCGRGCGTPRGDWKRHPPRRNSVIVHKIVLVFLKSLSSYNCERRISGIQKRAIEFAVLKLLNMDLHWNSAYLGRTLLVTCILYHRWIVTSMCQSQRWLTSTTSRSSALMWTRQINRRKLQRKKRHPSWPWTRCLRMRPPRSGYPYDVPDYAS

SEQ ID NO: 1121 - protein, 1749 aa, Artificial Sequence
  hINV- and HA-extended poly-FSP polypeptide 3B
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMGAAAASCQSPPSPRETTPSSDATRRTRPIAAQSKKTMTAAGLTPKNKKRRKLRPKMIRKIQKRRRTANRRNSRRATPTSKGSLRRKYLRVRGPPLHTRNIRKLIWTKQRSFLSLFPKLRATEQMTNVGCSIPHVPKATAAHSVTVKLQLPLTFSTLLWDSRHTMSLSNILMKFRLQSSPFLARSWNTMQWNNKKMAMTVIAGAHHCQYKLTYTKVWKMNWKKMMIGSQHLLFSPLDSSPLQLLLHPHGKRCNPCCRLTWMSQNTRSTNLEKNPSLKKQSQRRGKLSAFSGRILHQPEMAAMRLMPKFLNSTNSWWTLTTLSFVLIEEARQPSRPTGRTPTTRLMAPVGSVMSCSLLTQPSPASACTMPPLLHPQWAPHSAGLSPGACRPACTCISMTTISRATWGPVYYVCNRMNVSSVLKPFLFTVPIEDMRECTLGRNRMNVSSVLKPCLIPVPISEKKRKLPNIEITPQRSKAMLQKQCCYNLVIKHPLIFRINLRRQGKTKDGVVQSLGFLNQQIILQKEFFICLLMFIKRWKPAATKSRKKGHTKNRRKAKRKPQIYLFFLTVCGFHLKKTSAKWLKKSTKSRSNGMEACGTHPTPRLSCLRVRCGGWLCGWTPRGRKSGVMKCWDLCPVHKKRGLFRLDFHPRSSSGKGKNSPCCQKKLRVQNQGHLLMILLHNDRVFLVKIGEKLKHCFKAWGSRRNRRYRKIYGELKMSLQAFLIHLRKVDTHHLQVVTKTVTATTADGQRMRRLKCKACRLRWARPEPAAQAPPKSHFPPHPSGPSRTSSLQLRSLFFSHCLCSQKKDPAGKLKKLLKKSSQLRRSWRNVSRISTPPPLILWPQAAPVSVITMKLWEKHFKGLNWNLVVWILNLKMMTYMEMHYGHQAPQVAMLPKLLCRQMLPTLSTLQQRHPQGPCPPPVTPLRVQSVLLLGVPQTARGPRRKVLMVLWLPANQSLQKSQVFQWVLRTEVAPRCPRSAVDISPGPTSPSLASCASVAIGKLALLGASAPCGAAGAREAGRFAVLGTMVMKLCFFYLLYRLRIPSLRKYRQHLNRKLHLTRSCLIDLTMMMSQKLWKNQRKRIPLPSPRQHLLPQYPLHPPPPCLLLLHHRHHLAFLEMACSSQHTHSIKIWISFSHEVDPPGSVWILPCDLPRMLPISSPLHRPQMPFWTCTFPATTWGTWETPSTWGWRTFRGASSSTSRDSRSFFTSAHPSRPCRMRLYQCKKKLLLKLLTTTTSSPRRSPALRARGGTTIGEVTSCTNLSVPMMLTILIWKRVFILLLSDKKGAKKITFLPIPPHLRHPLLLFEKKRPEWLSMDLDGMLTVIGQGLVGMTPRDLGTVAGATAQIQRPIQVQTGGRLRRNLQRNLKVLQVSVYSGNLLSFSRRGMKSSVRLKNREWEKRKQILGGGGKYKEYFLKRILIRKAMTVLAGDKKGLGRFMRCVQSETKAVSLQLPLGRNMEHRLTMDSALSLTKREGPETLKKKYLVQHQMKCLTAVDCLQAFWDMGYPYDVPDYAS

SEQ ID NO: 1122 - protein, 1750 aa, Artificial Sequence
  hINV- and HA-extended poly-FSP polypeptide 4B
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMIQKKKQKSNLDLQHQRRRKKKKDKVEIRNRSPKANSTECQGEHSREQNLLNLVQLNPHSPHHRKDEEDHQKRHHHHNQKKMSVMAKKSQQPLGQAFGSLCQLVSADFSAPQVTRLRSLNHLLINEGNNHWPRVEMPTGWLLVGYNTRNTAQNPRLQQHLKHWQQCTRARWCQEPCQTLTFFHFFFFFKTVSLCCPGWSKGQPPPPGLKPSSLASQVARTTGVYQHVWLICFVFFVCVETGFCHVAQVGLERLVSLSGITDVNHWAQPKPSPSKGTGMNRPIGLRVGKGVWARLRASVSFWTLLPTTGVRTRGSPLRLTLWPPRNILNSLPSSMEIAVLQENRKTRKAAREKHRKTDNLHLCYYHSQSNRNKSRQMESLGMKLQSPLWDCSTTTGTHHGCLWEIPSVTLLACRVNAVEELHSRRMSVRIVKNWVSCCYVRLSAVGLSTWSALDVVINLKRLQKFSQKSQHHCALRKIEWATKLSLGGKAGPQAQEKANAKKMPFQRWIFSNQLTVQMLCLPIEALTALFTCRTASISVNISTLMSILEAPLFFHGDLCEEKKNGRISSQAPLRLWSWCGTSQTYFGSTAKKSPTSFCCEWGGQAHRQRNTGMEILLWILLKMEIQIFKICLGEMQLCTYTPHICRHTCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIFTSRILNLQVLKKILRSFMKLYHSLVMCLRLRTKLEKALSALFIWPQHSYKQRPPLQPVQVVLRLGNLPPFFRGSEVPFPRPCRTKMLNQKCLAPFITHPFASQPLGQEMPNNTQIRLLKPLLTPDTRWIFSNQLQTVQMLCLPPLKQGERIIWPLGGFQIPNFFWSLGIGHTGAWWHTGRRRREWGGSTVSRSPLWISSMIYLRGMAFASDSSIRTTRVSWCRRCGAKSAAASSLKKKPRDICRISDSKKMTQKRESTLGNFWMKLLQLPDKKKKSTEKTKIIKKMKKRIMVHMCSSLALPTGLTSLILPSSDLAVLISSSTSHFLMRSPVLPSSRLTCASPQLPRMWTWSSWLKWLKNWKRFKLKKKYILAMTLTLNGHPRTASITLPTTSLKGSRTSCCPRSHPRLPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRRELKKNLLLPCRCRREYRVTMGQAFGSFSADFSAPQVLKKNRKQNKIICKGHRITSLILSFQRVKLKKKVNACSPACTSKAWTPRKLVGRAVRRKGIICIKNMFLQRKGFLNLSHVEKFVPPSPPLALGPRMQLCTQLARFFPITPPVWHILGPQRHTPCQKKVPSASPWGLRPSPCLSWSSRIVAPGHALSCRTRRRWSSKGYPYDVPDYAS

SEQ ID NO: 1123 - DNA, 4641 bp, Artificial Sequence
  Polynucleotide encoding the hTPA- and HA-extended poly-FSP polypeptide 1A
atggatgcaatgaagagagggctctgctgtgtgctgctgctgtgtggagcagtcttcgtttcgcccagccaggaaatccatgcccgaaccgagatccagctgaccatgaacgacagcaagcacaagctggaaagccccgctctgaaacaggtgtcaccagcctctccacctactcagcagcctcagacacctcaggattctagacaggtgctggccctggccaagaaaaccctgacaaatgcctccagagccggacagtttcctgtgtggcggagaacaagcagaggcatgagcctgcagtggaagtccggcaatgcctgcacacctctgagatgccctagcagaagccctgccacattcctgacagccctgaatggctggcacagatctggcctgagagcccagatgcctagctcttggtctagcagcggcagaacactgaagctggcccctctgcaagtgaccaccactctgaagctgatcctggtcatgctggaaatcgtgaccgagcgctccctgctgtactccagaatgtgtctggtgcagatccccacacacacctgggagcccgattacttcgtgtccctgcctatgatgttcagctgggccacacagtcttttcccgtgggcgccgtgtttctgaccagacctgccattccttgctgcagctgtaccagccacagcaacccttggagccagagcaatcagcagctgaagtggacccctcacatcctgaagtccgccagcttcgacaagaaaggcttcgtgatcctgagccggcggagcaagattgaggcctctcctatcggctctatcgccagctctcctggacatcctctgggacctacactggccatcagattcatcagcgcccctcagcctagcagctctacagtgacagctgcccctagcggccagtactttatcgccaagaagcggatcaagctgcggcggaacaatatgggcggcaacagatccatctgcctgaccagaaagcgcaagagagagaagcggagccagaagtccaggcagaaccatctgcagctgaaaagctgcagacggaagatcagcaactggtccaagctgagaagcccctggatcttcaccaagtgcgagatctgcgtgaagaacaccgccatcctggctatcaccctgatcacccctcaggaccctcatctggaccctgtgtgtcaccctcatagaaggcctggatggaagggccaccatagagtggtgttctctcaccatcctagcggcagcacaaagagccactggcagcaaagagaacgcggaggcggcagacgcgagaagaagggatgtagagaacagcggaaggtggtcaagaacccctctcagcccgtgcctctgagaaacgatggcatcaccaacggcaacgactccaccagaagctgctccatcagcctgaagaaaagcctggaaaagatgcccctgatgcggagagccagacctaccagctgtagcacctgtagaatgtggtggaagggcaagaaacggcggaaagaaatcgtgcctatgagcctggcctgcagcatcaccgtgtcttttgtgggacagatcagcaccctggtgctggatgtgtctagcatcagccattggcggctgccctgtaaagtgaccgagagcagctccagcttcttctacaccagcgacaggacccctctgagcatcagcagaccaaccagcagagctagacagagctgttgtctgcccggactgacacaccctgctcaccaacctctgggcagcatgagcactagaagagagatgccaagccaggccacaccttctccacctggaccttggagagccgctctgggcaaagaagtgaagagatcccagagcaagctgcgcctgagaaacacaagccctggggagaagaacgatctccagctgttcgtgatgagcgacaccacctacaagatctactggacagtgatcctgctgaacccctgcggcaacctgcacctgaaaacaacatcactgcagcggccacctcggagcatcctgtctctgaatggaatctgggaagtgatgccccggacactggaaggctgcatcagcgtgaaggatcacagaaccagccagaaccacagcaagtgcatcaccgaatgtgtgcggactgccctgaacgtgtccaagaagagactgcctaagctgatgaagaagaaggacagcaccatcttcatcaacaaagtgcgccagaacttcaagcgcaacttcaagaagaagaaacccctcactttcagccccagcagacggatgactcggagaaccatgacaaccaccaaaatgatgatgatgcggcggaccaagcggagaaggcgcaaaaggcggagaatgaccatgatgaccagacggaccctgctgacaaagaaaacctgtctgacccctagaaccagcgccgccacaaaagctctgcctagacagaccatcagccagcggaggcctattcagaccccacctggaacatctctggccatctggggcagaacaagactgaccctgacaggcaccagatccagcggaacaagagcctctccttccgccgtgtgcctgtgttgttggacctgtccaagcagaagcttcccagccgcttctcctagtggactgagagcacctgttggagcccaggctcctcctgaagtgacactgagagcctcttgtgcctctagcgcctctaaagcctgtgctggactttggccttggggagcccaagttcgagttggagctggaacaggcggaggacctgcttgtgttcctgtggctgaagcttctacaggcgcatggacagctgaaggcgccgctggaacaagatgtagagcctctagagccccttgccgccaacttcctgctagctcccctaccaagtgtgaaatttgtgtgaagcgcagacggcggagaaagagaagcagccagtctagaagccccgtgcctaaaaagcgcgagaggatgatgctgcctgtgcgggccagaacagctagatctgcacttcctcagggcagagcacctctggaagggatgctgcttcctagagcactgcctagcctgctgagcagaatgcctgccagaagagagtcccggttttggctggctctgcaggcacttggactcagacctccacatctgcctagctgtcatcctctgcctcaactgttgggccctccacctcctcatcaggccccaatgacactgaaggccctggttaagacctggacacagttccgcaactaccccagagccgacaagaagaatgtccggtctaccgccttcttcctgctggacatcatcctgggcgattgcccaagaacaatggccggaccttctgcctctctgcatcctgcatctggcagagcctccagaaagacctggcagagaaggctgagagcttgtagagcaggcggacctgctggatgggctagacaggcctatcctagactgaaaaccttcggcgtgcccctgggctctattctgtgtctggccggcagcctgtccacaatgatgatcattagcaccaccagacaagagtgcggcaggcgggcttctgtgccttgtagacctatgatcggaagcgccagaccaggaccttggcggacatctgctatgcctagtgccatgggagtcgccctgcctacctcttgtgaaagcggaagatctcctcctgccaccggcggaagaatgccaggatctcagtctatcatgatgagctggatgcctccactggctccatgtgccgcttgtccatgttctcccgctcctacactgtgcccagcacatcctgctagagcaccaacagccgtgcctgcctttacacctctgtctgctcatcctgtgccagtgctgtctggatgtcacctggccgtcagaacctccatgctgacactgctgcccatggaagccaaaaagagcatgaagcggtccaacgctaagaaaatggaagatatgatctgggagagccggctgccactgaggccacaaagaggacctagacctctgcacagatggctgcagcagacaaccggctgtagccagaggcggatcgtgttctttctggccccatacttccctcggcaccctcacagatctccaccaacatcttgcccacctctgctggaagctttcccactgccaagagcttctctgagggccacagtgccaagacatagctctgttctcgccaccggtctgcacctccacagacagatttctctgcccctgagaggattcctcctgcaccaaccactgccaggacagcatctgtggctgtctcacagactgaggctgagactgcccaggacacagccatctttgcctggaccatgtgcaagcctgctgtccacactgtctcagccaccacctcaggctccatctcaagtgtggactgccgctacactgagatgtcctgctgttcctgcagctgcctgtcctcctgctctgagatccatgcctaagagccggaaccaggtgctgttcagacggaatctgaccccaagccagctgagaacactggccccaccttatatgctgctgccccagtctctgtcccagagcctgagtagaaagcagatccctagccagtccatgctcgtgggctacccctacgatgtccctgactatgcgtcc

SEQ ID NO: 1124 - DNA, 4623 bp, Artificial Sequence
  Polynucleotide encoding the hTPA- and HA-extended poly-FSP polypeptide 2A
atggatgcaatgaagagagggctctgctgtgtgctgctgctgtgtggagcagtcttcgtttcgcccagccaggaaatccatgcccgaagaaagatgcagagcctgaatcaccccagcagactgaccaatggctctcctccactgcacctgtgccagcctctgagaatgagcagaacccctcctagaagagtgtgcgccgctcctccacatagactgctgggcccttccagatggaaccctcggagaaagacctggaagatgcggaagaagtacgcccagaagcctagccagaagaaccacctgtacggcggcaagaagcgctctaagttcagcagaagccacctggacttcagcccctactggatgaagaaagtgaaggtgctgttcaaggccgaccagagcgagtctagcctgagcagcggaagatgcagcctgatggaacagatccctcacctgaagtctcggcggaagtggcagatcagacacgtgctgaagaacctgtggctgcccatgagaagcctgggagaaccttggagagccggctttcagtggggagagtctccttggcaagtgatggcctctctgaccggcagagccacatttctgctggccctttgggaatgtagcctgcctcaggcaagactgtgcctgatcgtgtctagaaccctgctgctggtgcagagccggaacaagaaaacaaagctgtggttcagcctgatcaacatccaccaccggaagaacccactgctgcctatgagatggtggtgtaccagaggcggcggaaagcggaaaaagaaaatgtgcaaggtgtccggcggctgcaccgcctgtgttgagagatgtccttggaagggcatctgctggaagtggcctgtgacagtggccgccattagaatgtgtgccctgtctcaccctagcttctacatcagcagcaccgtgtgctttctgagcaagcactgcatgaccgcctgcaccagaaagagaatgaagaccggcgccatccaagagaagggcgctattcaagagaaaggggccatgaccaagcggatctgcgtggtcaatttcgaggcctgcagagagatggaaagcctgagcgcccctgagaagatcaccctgtttgaagcccacatggcccggtgcacctccatcaatgtgctgtgtgtgcgggccagcctgattgagaagctgatgaaagaaaagcgcaagatgaagcggaaccaggtggcctctccacagatcatgcagcggctgttcatcaagggctaccagaacaaccacttcaccttccatctgcaaaacttcgccttcttcagctccttcggcaacaacaagtacatcaatatcctgaccatcctgttccacgtgcggaacatcgtgtacggcatccaagtgatgctgtgcgctagccctcagattatgcagagaaccagcgccgaccggttccggatgaagagaagaatgcagaatctggacaacctgggcgtgccatggcctctgttgcctggaatcccatctctgaacgcccagtggatgttcctgagaatcgcatccccgcaaatcatgcagaggatgagcgccgtgaacttcgagacaatccgggccagaaaccggaacatgaagaaaaccatgagccacctgatcgcccatcaggccctgaagatgagcggcctgagactgtttcaccccagactgctgacacggaagaagcccggaaaactgctgctcgcccatatgtacggcttcagcacctacggcacccagaaaggcgagtgcgtttgtctgcagtgtctgagcggcagcagcctgttcattctgaagcagcccctggacctgaagatcagcaagaccttcatgggccacagagagggcagcgagtctgataatctgggcctgctgtatagcttccctccaccttatcctatcagcgagggcctgaccatgaccaccggcagaaacatcaacagcaactccctgatgaccaactgcctgttcagccccatcttcctgtgccaccacgccatcatgcacagaaagatgacaagccctcacttcaggctgttcagcagcaagatcccacatcctcaggtgccatctgtggtggccctgtgcaagttccgggccttcatccacacacctagaagccctggctgcagcgtgtacgccaatatgtgctggcccaagttcttcctgaccttcagccagcagtggtccagcgtgacatctctggaatggacagcccaagagagaggctgcagcagctggctgatgaagcagacatggatgaagtcttggagcctgcgggaccccagctacagatccatcctggaatacgtgtccaccagagtgctgtggatgcctacctctaccgtgctgcaggctcatccacaagttccagctctggctcctcaagcctggtggcctgctagaagaggacctctgacatctgccccatccgctcagcagtccctgaccagagagaagattatcaaccccaccatcagctgcccctttcagagccccaccaagagactgatctaccctcctagcacctgttctctgccctgcagaggcttcctgcctagcagatttccttggggcccacctcctctgaacagcgtgatcgtgcacaagatcgtgctggtgttcctgaagtccctgtccagctacaactgcgagcggagaatcagcggcatccagaagagagccatcgagttcgccgtgctgaaactgctgaatatggacctgcctctcgagaacacacagatccccagaacaagcccactgtggaagatcacaatggtgctgacataccccaactgcgtggtgcatgtgctgatgtttggcgccctgagagccacagctcctgctacagctgcacctcaggctcagacccctcattggagagctgccacaacaagcagcatgagcagcagccctagagccgagcctacatcttctagctcttgggccacctgttggcccagatgctgctccagctcttgttactggtcactgtctagctggcctccagctggcgccgctgaagctacaaataccagaaccagaagccgcgagagccagaggggtagaatgctgacttggagaagctccctgtggttgcagggcaccagatgttttacaggcgtgcggaccagctccagatacaagaaaagaggcgtgatcgcctggcggagacagatcaatagacggaagctgcagagaaagaagcactggaacagcgcctacctgggcagaacactgctggtcacctgtatcctgtatcaccggtggatcgtgacctccatgtgtcagtcccagagatggctgaccagcaccacaagtagatctagcgccctgatgtggaccgagctgagcctggaaccatggattccctacctgcatcagcagaaaacccagcggacactggaatccgccggactgtttccttggctgcacacccagtgccaagagaagaaaagcagaaagctgatgtccagctgcacacacccctgcacaatgctgctgccacagggatgtcatcctgcctggctgagccctatctctgcctgtccaagactgctgccatatccttttcacgtgctggctctggaagtgacctttcctcctggaaccgccatgcctcagatgcagttgcaggctctggctatgtgggagaaaggctgggataagcctggcaccagcctgcagtgctacctgaacagaagaagaaacagccggaagcagagccaggtgcaactggccattcaggtgctgctcgtggacaagcacaagtactttctgttcggccaaaagaaaggccacatgatctttagcctggccaacggcctgtggtttaacctgattttcaactcccggaagaaactgctcgaggacatgaagcaaaatggcttcaccggcaaaggcctgacacaccccgtgcctctgaagcggactctgcagaacaaaagaaacaagaatatcaaacgcgtcaaccagaagaagggcaacatcaagcggaagtccatcctgctgcacctgattgtgctgaatagccccgagagcaacctgatcctgatccagcatggcggcatcttcacctttcggttctgggtcgagaagctgtcctggaacatctgcaagaacctgagcctgtacctggacaagttcgtgcagagactgctgtacgtgtacatcatcgagacaaacgtgttcgtgctgaacctgtttcatgtgcccgtgaaccagatcttcatgatggccttctacctgaagtacaccgagaaggcctgggtcatggaactggaatggctgatccaacagcagtgctatcagggcagctgcggcagagcttgttcttgtggaagaggctgtggcacccctagaggcgattggaagagacatcctcctcggagagccttctggaagcctcctagccagggcatctctagctgtctgatgaccggctgttggctcgagaagaaagctacctggatgcggcggacccgccggaagaagagggaagatcattgcggactgagacaccccagctggccttggacaagatgtctgaggatgaggcctccaagaagcggctacccctacgatgtccctgactatgcgtcc

SEQ ID NO: 1125 - DNA, 4638 bp, Artificial Sequence
  Polynucleotide encoding the hTPA- and HA-extended poly-FSP polypeptide 3A
atggatgcaatgaagagagggctctgctgtgtgctgctgctgtgtggagcagtcttcgtttcgcccagccaggaaatccatgcccgaggagctgctgctgcctcttgtcagtctcctccttctcctcgggaaaccacacctagctccgacgccaccagacggacaagacctattgccgctcagagcaagaaaaccatgacagccgccggactgacccctatgatccggaagatccagaagcggcggagaaccgccaaccggtgtctgagagttagatgtggcggctggctgtgtggctggacacctagaggacagaacaccagaagcaccaacctggaaaagaaccccagcctgaagaagcagagccagcggagaggaaagctgagcagcctgttcttcagccactgcctgtgccggaacagcagaagggccacacctacatctaagggcagcctgcggcggaagtacctgagagtgcctattcctccacacctgagacaccctctgctgctgatggacctggacggaatgctgaccgtgatcggacagggactcgtgggcatgacccctagagatctgggaacagtggctggcgccaccgctcagattcagaggcctattcaggtgcagaccggcggcagacttacacctcctcctctgattctgtggcctcaggccgctcctgttgatcctcctggctctgtgtggattctgccctgcaagaacaagaagcggagaaagctgcggcccaagcggctggactttcaccctagatcttctagcggcgtgtccgtgatcaccatgaagctgtgggagaagcacttcaagggcctgaactggaacctggtcgtctggattctgaacctgaagatgatgaacatcgagatcacccctcagcggagcaaggccagaaagtccggcgtgatgaagtgctgggatctgtgccccagcgagaagaagaggaagctgcctctgcctctgaccttcagcaccctgctgtgggactctagacatagaggcgccagctccagcaccagcagagactccagaagctttttcaccagcgctcaccccagcagaccctgcagaatgagactgtaccagttcctgatccacctgagaaaggtggacacccaccatctgcaggtcgtgaccaagaccgtgacagccacaacagctgacggccagagaatgcggagactgaagtgcaaggcctgccggctgagatgggctagacctgaacctgctgctcaggcccctccaaagagccactttccacctcatcctagcggccctagcagaaccagttctctgcagctgcggagcatccctcacgtgccaaaagccacagccgctcacagcgtgacagtgaagctgcagaagggaaagaacagcccctgctgccaaaagaaactgcgggtgcagaatcagggccatctgctgatgatcctgctgcacaatacctacatggaaatgcactacggccatcaggccccacaggtggccatgctgcctaagctgctgtgcagacagatgctgcccactctgagcacactgcagcaaagacacccacagggcccttgtcctccacctgtgacaccactgagagtccagtctgtcctgctgctgggagtgcctcagacagctgctagacagcctagcagacccaccggcagaacccctaccacaagactgatggcccctgtcggcagcgtgatgagctgttctctgctgacccagccttctccagccagcgcctgtacaatgcctccactgctgcatcctcagtgggccccacattctgctggattgtctcccggcgcttgcagacctgcctgtacctgtatcagcatgaccaccatctccagagccacctggcaggtttccgtgtacagcggcaatctgctgagcttctccagacggggcatgaagagtagcgtgcggctgaaaaacagccggcggaacagacggtacagaaagatctacggcgagctgaagatgtccctgcaggccgtggctcctagatgtcctagatctgccgtggacatcagccccggacctacctctcctagcctggcctcttgtgcctctgtggccattggaaaactggccctgcttggcgcttctgccccttgtggtgctgctggcgctagagaggctggaagatttgccgtgctgggcaccatggtcatgaagcacctgaaccgcaagctgcatctgacccggtcctgcctgatcgatctgaccatgatgatgagccagaagctctggaagaaccagcggaagagaatccctctgccatctcctagacagcatctgctccctcagtaccctctgcaccctcctccaccttgtctgctgctgctccaccacagacaccacctggcctttctggaaatggcctgcagcagccagcacacccactccatcaagatctggatcagctttagccacgagcagagcagcccattcctggccagatcctggaacaccatgcagtggaacaacaagaaaatggccatgacagtgatcgctggcgcccaccactgtcagtacaagctgacctacaccaaagtgtggaagatgaattggaagaaaatgatgatcggctcccagcacctcctgttcagccctctggatagctctccactgcaactgctgcttcaccctcacggcaagagatgcaacccttgctgcagactgacatggatgtccatgctgcagaaacagtgctgctacaacctcgtgatcaagcacccactgatcttcagaatcaacctgcggagacagggcaagaccaaggatggcgttgtgcagagcctgggcttcctgaaccagcagatcatcctgcagaaagagttcttcatctgcctgctcatgtttatcaagcggtggaagcctgccgccaccaagagagagtgggagaaacgcaagcagatcctcggcggaggcggcaagtacaaagagtacttcctgaagcgcatcctgattcggaaggccatgactgtgctggccggcgacaagaaaggcctgggcagattcatgagatgcgtgcagagcgagacaaaggccgttagcctgcagctcccactcggaagaggccctgtgtactacgtgtgcaaccggatgaacgtgtccagcgtgctgaagcccttcctgttcaccgtgcctatcgaggacatgagagagtgcacactgggccgcaacagaatgaatgtgtcctctgtgctgaaaccctgtctgatccctgtgccaatcgacctgcctcggatgctgccaatcagcagcccactgcacagaccccagatgccattctggacctgcacctttcctgccacaacatggggcacctgggagacaccttctacatggggctggcggacctttcggggccctagaagaaaagtgctgatggtgctgtggctgcccgccaaccagagtctgcagaaaagccaagtgttccagtgggtcctgcggaccgagaacatccggaagctgatctggaccaagcagcggagcttcctgtctctgttccccaagctgagagccaccgaacagatgaccaatgtgggctgcgccttcagcggccggattctgcatcaacctgaaatggccgccatgcggctgatgcccaagttcctgaatagcaccaacagctggtggacctgtaccaacctgagcgtgcccatgatgctgaccattctgatttggaagcgggtgttcattctcctgctgtccgacaagaagctgctgaagaagtctagccagctgaggcggtcttggagaaacgtgtcccggatcagccaccagatgaagtgtctgaccgccgtggactgtctgcaggccttctgggacatgaacatggaacaccggctgaccatggacagcgccctgagcctgacaaagagagagggacccgagacttgcaagaagaagctcctgctgaaactgctgacaatgagcctgagcaacatcctgatgaagttccggctgcggctgagaatcccaagcctgaggaagtatcgccagcatctgaaaaagaccagcgccaagggcgagaagctgaagcactgctttaaggcttggggcagaggcccacctctgcacacaagaagccagaagaaagaccctgccggcaagctgaaaaaactgaccacactgagcttcgtgctgatcgaggaacggcggaacctgcagcggaatctgaaagtcctgtggctcaagaaaagcaccaagagccggtatctgttcttcctgaccgtgtgcggcttcttcgagaagaaacggcctgagtggctgtcctccagaaagaagggacacacaaagaatcggaggaaggccaagcggaagccccagatcgtgcacaagaagagaggcctgttcctcaaaaagaaatacctggtgcagggcgccaagaagatcaccttcctgtccaacggcatggaagcttgcggcacacaccccacaccaagactgagcgacagagtgttcctggtcaagatcaccaccaccacaagcagccccagaagaagcccagcactgagagctagaggcggcaccacaattggcgaagtgaccagcctgtgcttcttctacctgctgtacggctacccctacgatgtccctgactatgcgtcc

SEQ ID NO: 1126 - DNA, 4641 bp, Artificial Sequence
  Polynucleotide encoding the hTPA- and HA-extended poly-FSP polypeptide 4A
atggatgcaatgaagagagggctctgctgtgtgctgctgctgtgtggagcagtcttcgtttcgcccagccaggaaatccatgcccgaatccagaagaagaaacagaaatccatggccaagaagtcccagcagcctctggtgctgaagaagaaccggaagcaagagtggggaggacaggcccacagacagagaaacaacgccaagaagatgcccttccaagaggaaaagaagaacggccggatcagcagcagcctgatcctgagcttccagagagtgaaggacagcaagaaaatgacccagaagatgtgcagctctctggccctgcctacaggcctgacatctctgatcctgcctagcagcgatctggccgtgctgatctctagcagcaccagccactttctgatgcggagccctgtgctgccaagctccagactgacatgtgcctctccacagctgccccggatgtggacatggtctagctggctgaagcaccccagaaccgctagcatcacactgcctaccacaagcctgaagggcagcagaaccagctgctgcccaagatctcaccccagactgcctaggaccaagtggcctctgcagtgtctgctgcacagcctgggaacaacaggcacactcgtttgggaaaggggcgtgctgcagatgagaagcctcgaagcccattgtcctctgcagaccttccatctgcaccactgcagaacccagccaagctcttgtcctcctgcctggattctgtaccaaggccagtggagcggagccgtcgttggacttagacccgtggctcaccatctgcctagacctatccagggcctgcactgtcctcaggctcctcatcaacctgctctgagctggggaaagtggcccgtgggaatgacaggacctgccagatgctgtcggtggccccgcagatctcagaagtctcagcatcactgcgccctgcggaagatcgagtgggccacaaaactgtctctcggcggaaaagccggaccacaggctcaagagaaggccagaccttctccttgcctgtcctggtccagcagaattgtggcccctggacacgccctgagctgtcggactcgtagaagatggtcctccaagtgcagaggcggccctagcgccagcgatagatgttgtagctgtagccccagcggcttcagcgccggaagaggcagatgtcctgtgcagggatgtctgaggccacacagagttcagctgctgagaagatggggcccaggatctcctgctggccagagactgtctaagggcttccaactgctgcgttggtggggacctggatctccagctcctgagcctagaaagggcccatttcctccacctgatcctccatggcctgtgaccgctgtgacagtgatggctggctctgtgcctagcgcacagtctgtggatgccctggaatctcctggacctctggctctggaaggccctagcagccctagaaacctgctgtggcgggaaatgagcatctttctgcccggcatcttctgccaaaagaaggtgccatctgccagcccctggggacttgttcctccttctccaccactcgctctgggccctagaatgcagctgtgtacccagctcgccagattcttccccatcacacctccagtgtggcacatcctgggacctcagagacacacacctcaggtggtcctgagactgggcaacctgcctccattcttcagaggcagcgaggtgccctttcctagaccttgccggaccaagaacgagggcaacaatcactggcccagagtggaaatgcctaccggctggctgctcgtgggctacaacaccagaaacacagcccagaatcctcggctgcagcagcatctgaaacactggcagcagtgcacacgggccagatggtgtcaagagccttgtcagaccctgaccttcttccacttcttcttctttttcaaaacggtgtccctgtgttgtcccggctggtccaaaggacaacctccacctcctggcctgaagccttctagcctggcttctcaggtggccagaaccacaggcgtgtaccagcacgtgtggctgatctgcttcgtgttcttcgtgtgcgtggaaaccggcttctgtcacgtggcacaagtgggcctcgagagactggtttctctgagcggcatcaccgacgtgaaccattgggcccagcctaagccatctcctagcaaaggcaccggcatgaacagacccatcggcctgagagttggcaaaggcgtgtgggccagactgctcaagaagaagcctagagacatctgtcggatctccaacagaaagacccggaaggccgccagagagaagcaccgcaaaacagatagagccagcgtgtccttctggactctgctgcctacaacaggcgtgcggacaagaggaagccctctgagactgactctgtggcctcctagatgcagatgcagacgcgagtacagagtgaccatgaacatcctgaacagcctgccaagcagcatggaaatcgccgtgctgcaagaaaccgccaagaaaagccctaccagcttctgctgcaacctggacctgcagcatcagcgcagacgcaaaaagaagaaagacaaggtcgagatccggaatcggagccccaaggccaatagcacagagtgtcagggcgagcacagcagagagcagaatctgctgaatctggtgcagctgaatcctcacagccctcaccaccggaaggacgaagaggaccaccagaagagacaccaccaccacaatcaaaagaagatgagcgtcccactgttcttccacggcgacctgtgtagagagagcaccctgggcaatttctggatgaagctgctccagctgcctcagaggcctccactgcaaccagtgaccggaatggaaatcctgctttggattctgctgaagatggaaattcagatcttcaagatttgcctgggcgagatgcagctctgcacctctcggattctgaacctgcaagtgctgaaaaagatcctgcggagctttatgaagctgtaccacagcctcgtgatgtgcctgcggctgaggaccaagctggaaaaggctctgagcgccctgttcatctggcctcagcactcctacaagatcacacacccattcgccagccagccactgggacaagagatgcccaacaacacccagatccggctgctgaagcccgacaagaagaagaaaagcaccgaaaagaccaaaggccaggctttcggcagcttctccgccgatttttcagcccctcaaggacaggcttttggctccctgtgtcagctggtgtccgccgactttagcgccccacaagtgaccagactgcggagcctgaaccatctgctgatttggctgaagaattggaagcggttcaagctcaaaaagaaatatcaggcccctctgcggctgtggtcttggtgcggaacaagccagacctacttcggcagcatcatctgtatcaagaatatgttcctgcagcggaagggtttcctgaacctgagccacgtggaaaagttcgagcttaagaagaatcttctgctccccgtcgtgatcaacctgaagagactgcagaaattcatgctgaaccagaagtgcctggctccatttcctgcctgcaccagcaaagcctggacacccagaaaactcgtgggcagagccgtgcggagaaagggcattctggccatgacactgaccctgaacggaatcgaggccctgacagccctgtttacctgtagaaccgcctccatcagcgtgaacatcagcaccctgatgagcatcctggaagccatcatcaagaagatgaagaaacggatcatggtgcaccggtggatcttctccaatcagctgaccgtgcagatgctctgcctgcctctgctgacccctgacaccagatggatctttagtaatcagctgcagacagtgcaaatgctgtgtctgccacctctgaagcagggcgagagaatcatttggccactcggcggctttcagatccccaatttcttctggtccctcggcatcggacacactggcgcatggtggcatactggtagaaggcggagagagtggggcggctctaccgtgtctagaagcccactgtggatcagctccatgatctacctgagaggcatggccttcgccagcgacagctccatcagaaccaccagagtgtcctggtgtcggagatgtggcgccaagtctgccgcagcctcttcttctccactgtgggattgcagcaccacaaccggcacacaccacggatgcctgtgggagatccctagcgttaccctgctggctaacctgcacctgtgctactaccactctcagagcaacagaaacaagagccgccagatggaatccctgggcatgaagctccaacttaaaaagaaagtgaacgcctgcagcacctacacaccccacatctgcagacacacctgtcgcgtgaacgccgtcgaggaactgcactctagaaggatgtccgtgcggatcgtgaaaaattgggtgtcctgctgctacgtgcggctgtcagctgtgggactgtctacttggagcgctctggacaacaagatcatctgcaagggccacagaatcaccggctacccctacgatgtccctgactatgcgtcc

SEQ ID NO: 1127 - DNA, 4641 bp, Artificial Sequence
  Polynucleotide encoding the hTPA- and HA-extended poly-FSP polypeptide 1B
atggatgcaatgaagagagggctctgctgtgtgctgctgctgtgtggagcagtcttcgtttcgcccagccaggaaatccatgcccgaaccgagatccaattgaccatgaacgacagcaagcacaagctggaaagccccgctctgaaacaggtgtcaccagcctctccacctactcagcagcctcagacacctcaggatagcagacaggtgctggccatgcctagcagctggtctagctctggcagaacccagcggaaggtggtcaagaatcctagccagcctgtgcctctgagaaacgacggcatcaccaacggcaacgactccaccagaagctgcagcatcagcctgaagaaaagcctggaaaagatgcccctcatgatgaagaagaaggacagcaccatcttcatcgtgcccatgagcctggcctgtagcatcaccgtgtctttcgtgggccagatcagcacactggtgctggatgtgtccagcatctcccactggaacaaagtgcggcagaacttcaagcggaacgccgacaagaagaacgttcggagcggcgagaagaacgacctgcagctgtttgtgatgagcgacaccacctacaagatctactggaccgtgatcctgctgaacccctgcggcaatctgcacctgaaaaccaccagcctgggcgactgtcctagaacaatggccggaccttctgcctctctgcaccctgcatctggcagagcctctagaaagacctggcagagaaggctgagagcctgtagagctggtggacctgctggatgggccagacaggccttcgataagaaaggctttgtgatcctgagcgtcggagccggaacaggcggaggacctgcttgtgttcctgtggctgaagcttctacaggcgcttggacagctgaaggcgccgctggaacaagatgtagagcttctagagccccttgcagacagctgcctgccagctctcctaccaagtgcgagatctgcgtgaagcgcagacggcggagaaagagaagcagccagtctagaagccccgtgcctaagaaacgcgagagaatgatgctgcccgtgcgggccagaacagctagatctgcacttcctcaggggagagcccctcttgagggaatgctgcttcctagagcactgcccagcctgctgtctagaatgccagccagaagagagagccggttttggctggctctgcaggcacttggactcagacctccacatctgcctagctgtcatcctctgcctcaactgcttggccctccacctcctcatcaggcccctacagctttcttcctgctggacatcattctgcggctgccctgcaaagtgaccgagtctagcaatatgggcggcaacagatccatctgcctgaccaacgccaagaaaatggaagatatgatctgggagagcacgcccctgagcatcagcagacctacatctagagccaggcagagctgttgtctgcccggactgacacatcctgctcaccagccactgggatctatgaccctggccatcagattcatcagcgctcctcagcctagctccagcacagtgacagctgctcctagcggccagtacttcaagggcaagaagcggcggaaagagatcttcaagaagaagaaacccctgacattcagccccagcctggccaaaaagaccctgaccaatagcagcttcttctacaccagcgaccgcgaggccaagaaatctatgaagcggagcatgaccctgaaggccctggtcaagacctggacacagttcagaaactaccccagagcctcctctcctggacaccctctgggacctaatggcatctgggaagtgatgcccagaacactggaaggctgcatctccgtgaaggaccacagaacaagccagaaccacagcaagtgcatcaccgagtgtgtgcggacagccctgaacagaagaagcaagatcgaggcctctcctatcggctctatcgccctgagatccatgcctaagagcagaaaccaggtgctgttcagacggaatctgaccccaagccagctgagaactctggcccctccttatatgctgctgccccagtctctgagccagagcctgagcagaaagcagatccctagccagtccatgctggtggcctctagagcaggacagtttcctgtgtggcggagaaccagcagaggaatgagcctgcagtggaagtccggcaatgcctgcacacctctgagatgccctagcagaagccctgccacattcctgacagctctgaacggctggcacagatctggactgagagcccagagaaagcgcaagcgcgagaagagaagccagaagtccaggcagaaccatctgcagctgaagtcctgccggcgcaagatctccaactggtccaagctgagaagcccctggatcttcgtgtccaagaagagactgcccaagctgaccaagtgtgaaatctgtgtcaagaacaccgccatcctggctatcaccctgatcacccctcaggaccctcatctggaccctgtgtgtcaccctcatagaaggcctggatggaagggccaccacagagtggtgttttctcatcaccctagcggcagcaccaagagccactggcagcaaagagaacgcggaggcggcagacgggaaaagaagggctgtagagagagatccctgctgtactccagaatgtgcctggtgcagatccccacacacacctgggagcccgattacttcgtgtctctgcccatgatgttcagctgggccacacagtcattccccgtgggagccgtgtttctgaccagacctgccattccttgctgtagctgcacaagccacagcaacccttggagtcagagcagacacccacacagaagcccacctacctcttgtcctccgctgctggaagcctttccactgcctagagcatccctgagagccaccgtgccaagacatagctctgtgctggcaaccggactgcatctgcacagacagatttctctgcccctgagaggattcctgctgcatcaaccactgccaggccagcatctgtggctgtctcatagactgcggctgagactgccaagaactcagcggcctcctagatccatcctgagccttagactgccactgaggccacagagaggacccagacctctgcatagatggctgcagcagaccacaggctgtagccagagaagataccccagactgaaaaccttcggcgtgccactgggctccattctgtgtctggctggatctctgagcaccatgatgatcattagcaccaccagacaagagtgtggcaggcgggcatctgtgccctgtagacctatgatcggaagcgccagaccaggaccttggagaacatctgctatgcctagcgccatgggcgtcgcactgcctacaagctgtgaatccggaagatctcctcctgccaccggcggaagaatgcctggaagccagagcattatgatgagctggatgcctcctctggctccttgtgccgcttgtccttgttctcccgctcctacactgtgtcccgctcatcctgctagagcacctacagccgtgcctgcctttacacctctgtctgcacatcctgtgcctgtgctgtctggatgtcacctggccgtcagaacctccatgctgacactgctgcctatgctgaagctggccccactgcaagtgaccaccacactgaagctgatcctggtcatgctggaaatcgtgaccgagagcactcggagagagatgccttctcaggccacaccttctccacctggaccttggcgagccgctctgggcaaagaagtgaagagatcccagagcaagctgcgcctgagaaacacaagccccatcgtgttctttctggccccatacttccccagacggatgaccagacggaccatgacaaccaccaaaatgatgatgatgcggcggaccaagcggagaaggcgcaaaaggcggagaatgacaatgatgacaaggcggaccctgctgacaaagaaaacctgtctgacccctagaaccagcgccgctaccaaagctctgccaaggcagacaatctcccagcggaggcctattcagacccctcctggaacatctctggccatctggggcaaccagcagctgaaatggacccctcacatcctgaagtccgccagcagaagggccagacctaccagctgtagcacctgtagaatgtggtggatcgccaaaaagcggatcaagctgcggcggaacagaaccagactgacactgacaggcacaagaagcagcggcaccagagcttctccatccgccgtttgcctgtgttgctggacctgtccttccagaagcttcccagccgcttctccaagcggattgagagcacctgttggagcacaggcccctccagaagttacactgagagctagctgtgcctccagcgcctctaaggcttgtgctggactttggccttggggagcacaagttcggcaaccatctttgcctggaccatgcgcttctctgctgagcacactgtctcagccacctccacaggctccatctcaagtgtggacagccgcaacactgagatgtcctgctgttccagctgctgcctgtcctcctggctacccctacgatgtccctgactatgcgtcc

SEQ ID NO: 1128 - DNA, 4623 bp, Artificial Sequence
  Polynucleotide encoding the hTPA- and HA-extended poly-FSP polypeptide 2B
atggatgcaatgaagagagggctctgctgtgtgctgctgctgtgtggagcagtcttcgtttcgcccagccaggaaatccatgcccgaagaaagatgcagagcctgaatcaccccagcagactgaccaacatgagcagaacacctccaagacgcgtgtgcaaccctcggagaaagacctggaagatgcggaagaagtacgcccagaagcctagccagaagaaccacctgtacaacagccggaagaaactgctcgaggacatgaagcagaatggcttcacaggccacagagagggcagcgagtctgataatctgggcctgctgtactcctttcctcctatccggatgtgcgccctgtctcaccctagcttctacatcagcagcaccgtgtgctttctgagcaagcactgcatgaccgcctgcacacaaaagaaaggccacatgatcttcagccgcgagaagatcatcaaccccaccatcagctgcccctttcagagccccacaaagcggctggaactgagcctggaaccttggattccctacctgcaccagcagaaaacccaaggcggcaagaagagaagcaagttccctggcaccagcctgcagtgctacctgaacagatgcagcctgatggaacagatccctcacctgaagtccgcctctccacagatcatgcagagaaccagcgccgaccggttccggatgaagcggagaatgcagaacctggacaatctgggcgttccatggccactgctgcctggacctctggaaaacacacagatccccagaacaagccctctgtggaagatcacaatggtgctgacataccccaactgcgtggtgcacgtgctgatgttctggctgcctatgagatctctgggcgagccttggagagctggctttcagtggggagagtccccttggcaagtgatggctagcctgacaggcccctatcctatcagcgagggcctgaccatgaccaccggcagaaacatcaacagcaactccctgatgaccaactgcctgttcagccccatcttcctgtgccaccacgccatcatgcaccggaagatgacaagcccacacttcagactgttcagcagcaagatcccacatcctcaggtgccatctgtggtggccctgtgcaagttcagagccacatttctgctcgccctgtgggagtgtagtctgcctcaagccagactgtgcctgatcgtgtctagaaccctgctgctggttcagtctgccgctcctccacatagactgctgggcccttctagatggtccagaagccacctggacttcagcccctactggatgaagaaagtgaagctggccaacggcctgtggttcaacctgatcttcgtgctgttcaaggccgaccagagcgagtctagcctgtctagcggccggaacaagaaaacaaagctgtggttctccctcatcaacatccaccaccgcaagaatcctctgctgcccatgagaatccccagcctgaatgcccagtggatgttcctgagaatcctgcttctggcccatatgtacggcttcagcacctacggcacccagaaaggcgagtgcgtttgtctgcagtgtctgagcggcagcagcctgttcattctgaagcagcccctggacctgaagatctccaagaccttcatgctgcaagctcacccacaggtgccagctcttgctcctcaagcttggtggcctgctagaagaggccctctgacatctgctccatccgctcagcagtctctgacagctagccctcagattatgcagcggatgagcgccgtgaacttcgagacaatcatctaccctccaagcacctgtagcctgccttgtagaggcagaacactggaaagcgccggactgtttccttggctgcacacccagtgtacacacccctgtaccatgctgctgccacaaggctggtggtgtacaagaggcggcggaaagcggaaaaagaaaatgtgcaaggtgtccggcggctgcaccgcctgtgttgagagatgtccttggaagggcatctgctggaagtggccagtgacagtggctgctcagtggtctagcgtgacctctctggaatggacagcccaagagagaggctgcagcagctggctgatgaagcaaacatggatgaagtcttggtccctgcgggaccccagctacagatccatcctggaatacgtgtccaccagagtgctgtggatgcccacaagcaccgtgcggagaagaaacagcagaaagcagtctcaggtgcagctggccattcaggtgctgctcgtggacaagcacaagtactttctgttcggcagagcccgcaaccggaacatgaagaaaaccatgagccacctgatcgcccatcaggccctgaagatgagcggcctgaggctgtttcatcctcggctgctgacaagaaagaagcccggcaagttcctgcctagcagatttccttggggccctcctcctctgtgtcatcctgcttggctgagccctatctccgcctgtccaagactgctgccatatccttttcacgtgctggccctggaagtgacctttccacctggaacagccatgcctcagatgcaactgcaggccctggccatgtgggagaaaggctgggataagcggaagagaatgaagaccggcgccatccaagagaagggcgctattcaagagaaaggggccatgaccaagcggatctgcgtggtcaatttcgaggcctgcagagagatggaaagcctgagcgcccctgagaagattaccctgtttgaagcccatatggcccggtgcacctccatcaatgtgctgtgtgtcagagcctctctgatcgagaagctgatgaaagaaaagcgcaagatgaagcgcaaccaggtggcatccccacaaattatgcagaggctgttcattaagggctaccagaacaaccacttcaccttccatctgcaaaacttcgccttcttcagcagcttcggcaacaacaagtacatcaatatcctgacgcggcgcaagaaaagagaggaccactgcggactgctgatcctgatccagcacggcggcatcttcacctttcggttctgggtcgaaaagctgagctggaacatctgcaagaacctgagcctgtacctggataagttcgtgcagcggctgctgtacgtgtacatcatcgagacaaacgtgttcgtgctgaacctgttccacgtgccagtgaaccagatcttcatgatggccttctacctgaagtacaccgagaaggcctgggtcatggaactggaatggctgatccaacagcagtgttaccagcaagagaagaaaagccggaaactgatgagcagctgccgggccttcatccacacacctagaagccctggctgcagcgtgtacgccaatatgtgctgggccttttggaagcctcctagccagggcatcagctcttgtctgatgacaggctgttggggcagccctcctctgcacctgtgtcagcctctgaggcggtataagaaaaggggcgtgatcgcctggcggcggagaaagtggcagatccggcatgtgctgaaaaacctgatcctgtttcatgtgcggaacatcgtgtacggcatccaagtgatgctgtgcggcaagggactgacacaccctgtgcctctgaaacggaccctgcagaacaagaggaacaagaacatcaagcgggtcaaccagaagaagggcaacatcaagaggaagtccatcctgctgcacctcattgtgctgaatagccccgagagcaaccccaagttcttcctgacctttagccagctcgagaagaaagctacctggatgagaagaacaggcgccctgagagccacagctcctgctacagcagctcctcaggctcagactcctcattggagagccgccacaacaagcagcatgagcagcagccctagagccgagcctacatcttctagctcttgggccacctgttggcccagatgctgtagctccagctgttactggtccctgagttcttggcctcctgctggcgccgctgaggctacaaacaccagaactagaagcagagagtcccagcggggcagaatgctgacttggagaagtagtctgtggctgcagggcaccagatgttttacaggcgtgcggacaagcagcggaagctgtggcagagcttgtagctgcggaagaggctgtggaacccctagaggcgattggaagagacaccctcctcggaggaatagcgtgatcgtgcacaagatcgtgctggtgtttctgaagtccctgtccagctacaactgcgagagaaggatcagcggcatccagaagagagccatcgagtttgccgtgctgaaactgctgaatatggacctgcactggaactccgcctacctgggcagaactctgctggtcacctgtatcctgtatcaccggtggatcgtgacctccatgtgccagtctcagagatggctgaccagcaccacaagcagatccagcgctctgatgtggacccggcagatcaatcggaggaagctgcagagaaagaagaggcacccaagctggccttggaccagatgccttagaatgaggcctcctagaagcggctacccctacgatgtccctgactatgcgtcc

SEQ ID NO: 1129 - DNA, 4638 bp, Artificial Sequence
  Polynucleotide encoding the hTPA- and HA-extended poly-FSP polypeptide 3B
atggatgcaatgaagagagggctctgctgtgtgctgctgctgtgtggagcagtcttcgtttcgcccagccaggaaatccatgcccgaggagctgctgctgcctcttgtcagtctcctccttctcctcgggaaaccacacctagctccgacgccaccagacggacaagaccaattgccgctcagagcaagaaaaccatgacagccgccggactgacccctaagaacaagaagcggagaaagctgcggcccaagatgatccggaagatccagaagagaaggcggaccgccaaccggcggaatagcagaagggctacccctacaagcaagggcagcctgagaagaaagtacctgagagtgcggggacctcctctgcacacccggaacatcagaaagctgatctggaccaagcagcggagcttcctgtctctgttccccaagctgagagccaccgagcagatgaccaatgtgggctgctctatccctcacgtgcccaaagccacagccgctcactctgtgacagtgaaactgcagctgcccctgaccttcagcaccctgctgtgggatagcagacacaccatgagcctgagcaacatcctgatgaagttccggctgcagtctagcccattcctggccagatcctggaacaccatgcagtggaacaacaagaaaatggccatgaccgtgatcgctggcgcccaccactgtcagtacaagctgacctacaccaaagtgtggaagatgaactggaagaaaatgatgatcggcagccagcatctgctgttcagccctctggatagcagtcccctgcagctcctgctgcaccctcacggcaagagatgcaacccttgctgcagactgacctggatgagccagaacaccagaagcaccaacctggaaaagaaccccagcctgaagaagcagagccagcggagaggaaagctgagcgcctttagcggcagaatcctgcaccagccagaaatggccgccatgagactgatgcccaagttcctgaactccaccaacagctggtggaccctgaccacactgagcttcgtgctgatcgaggaagccagacagcccagcagacctaccggcagaacacctaccaccagactgatggcccctgtgggcagcgtgatgagctgttctctgctgacccagccttctccagccagcgcctgtacaatgcctccactgctgcatccacagtgggcccctcatagtgctggactttctccaggcgcttgcagacctgcctgcacctgtatcagcatgaccaccatcagcagggccacatggggcccagtgtactacgtgtgcaaccggatgaacgtgtccagcgtgctgaagcccttcctgttcaccgtgcctatcgaggacatgagagagtgcaccctgggcagaaacagaatgaatgtgtcctctgtgctgaaaccctgtctgatccctgtgccaatcagcgagaagaagaggaagctgcccaacatcgagatcacccctcagcggtctaaggccatgctgcagaagcagtgctgctacaacctcgtgatcaagcaccctctgatcttcagaatcaacctgcggcggcagggcaagaccaaagatggcgttgtgcagagcctgggcttcctcaaccagcagatcatcctgcagaaagagttcttcatctgcctgctcatgttcatcaagcggtggaagcctgccgccaccaagagcagaaagaagggccacaccaagaacagacggaaggccaagagaaagccccagatctacctgttcttcctgaccgtgtgcggctttcacctgaaaaagaccagcgccaagtggctgaagaagtccaccaagtccagatccaacggcatggaagcttgcggcacacaccccactcctagactgagctgcctgagagttagatgcggcggctggctgtgtggctggacacctagaggtagaaagtccggcgtgatgaagtgctgggatctgtgccccgtgcacaagaagagaggcctgttcagactggattttcaccccagaagcagctccggcaagggaaagaacagcccctgctgccaaaagaaactgcgggtgcagaaccagggccatctgctgatgattctgctgcacaatgaccgggtgttcctcgtgaagatcggcgagaagctgaagcactgtttcaaggcctggggctccagacggaaccggcggtacagaaagatctacggcgagctgaagatgtccctgcaggccttcctgatccacctgagaaaggtggacacccaccacctccaggtggtcaccaaaacagtgaccgccacaacagccgacggccagagaatgcggagactgaagtgcaaggcctgccggctgagatgggccagacctgaacctgctgctcaggcccctcctaagagccactttccacctcatcctagcggccccagcagaacaagtagcctgcagctgagaagcctgttctttagccactgcctgtgcagccagaagaaggaccctgccggcaagctgaaaaagctgctgaagaaaagcagccagctgcggagaagctggcgcaatgtgtccagaatcagcacccctcctccactgatcctgtggcctcaagctgctcctgtgtccgtgatcaccatgaagctgtgggagaagcacttcaagggcctgaattggaacctggtcgtgtggattctgaacctgaagatgatgacctacatggaaatgcactacggccatcaggccccacaggtggcaatgctgcctaagctgctgtgcagacagatgctgcccactctgagcacactgcagcagagacatcctcagggcccttgtcctcctcctgtgacacctctgagagtccagtctgtcctgctgctgggagtgcctcagacagccagaggacctagaagaaaggtcctgatggtgctgtggctgcccgccaatcagtctctgcagaaaagccaggttttccagtgggtgctgcggacagaggtggcccctagatgtcctagatctgccgtggacatcagccccggacctacatctcctagcctggcctcttgtgcctctgtggccattggaaagctggcactgcttggcgcctctgctccttgtggtgctgctggcgctagagaggccggaagatttgctgtgctgggcaccatggtcatgaagctttgtttcttctacctgctgtaccggctgcgcatcccaagcctgaggaagtacagacagcacctgaaccggaagctgcacctgacaagatcctgcctgatcgatctgaccatgatgatgtcccagaagctctggaagaaccagcggaagagaatccctctgccatctccacggcaacatctgctgccacagtaccctctgcacccacctccaccttgtctgctgttgctgcaccatagacaccacctggcctttctcgagatggcctgtagctctcagcacacccacagcatcaagatctggatcagcttcagccatgaagtggaccctccaggcagcgtgtggatactgccttgcgatctgcctcggatgctgccaatctcttcacccctgcacagaccccagatgcctttctggacctgcacctttcctgccacaacctggggcacatgggagacaccttctacatggggctggcggactttcagaggcgctagcagcagcacatcccgggacagcagatccttcttcacctctgctcaccctagcaggccctgcagaatgagactgtaccagtgcaagaagaagctcctcctgaaactgctgaccaccaccacaagcagccccagaagatcccctgctctgagagcaagaggcggcaccacaatcggcgaagtgaccagctgtaccaacctgagcgtgcccatgatgctgaccatcctgatttggaagcgggtgttcatcctcctgctgagcgataagaagggcgccaagaagatcaccttcctgcctattcctccacacctgagacaccctctgctgctgttcgagaagaaacggcctgagtggctgagcatggacctggacggaatgctgacagtgatcggccagggactcgtgggcatgacccctagagatctgggaacagtggcaggcgccaccgctcagattcagcgacctatccaggtgcagactggcggcagactcagaagaaacctgcagagaaacctgaaggtgctccaggtgtccgtgtacagcggcaacctgctgtcctttagcagacggggcatgaagtctagcgtgcggctgaaaaaccgcgagtgggagaaacggaagcagattctcggaggcggcggaaagtacaaagagtacttcctgaagcgcatcctcatccggaaggctatgacagtgctggccggcgacaagaaaggactgggcagattcatgagatgcgtgcagagcgagacaaaggccgtgtctctgcaactgcctctgggaagaaacatggaacaccggttgaccatggacagcgccctgagcctgacaaagagagagggacccgagacactcaaaaagaaatacctggtccagcaccagatgaagtgtctgaccgccgtggattgtctgcaggctttttgggacatgggctacccctacgatgtccctgactatgcgtcc

SEQ ID NO: 1130 - DNA, 4641 bp, Artificial Sequence
  Polynucleotide encoding the hTPA- and HA-extended poly-FSP polypeptide 4B
atggatgcaatgaagagagggctctgctgtgtgctgctgctgtgtggagcagtcttcgtttcgcccagccaggaaatccatgcccgaatccagaagaagaagcagaagtccaacctggacctgcagcaccagcgcagacgcaaaaagaagaaggacaaggtcgagatccggaatcggagccccaaggccaatagcacagagtgtcagggcgagcacagcagagagcagaacctgctgaatctggtgcagctgaaccctcacagccctcaccacagaaaggacgaagaggaccaccagaagcggcaccaccaccacaatcaaaagaaaatgagcgtgatggccaagaagtcccagcagcctctcggacaggcctttggctctctgtgtcagctggtgtccgccgatttcagcgcccctcaagtgaccagactgcggagcctgaaccatctgctgatcaacgagggcaacaaccactggcctagagtggaaatgcctaccggttggctgctcgtgggctacaacaccagaaacacagcccagaatcctcggctgcagcagcacctgaaacactggcagcagtgcaccagagccagatggtgccaagagccttgtcagaccctgaccttcttccatttcttcttctttttcaaaacggtgtccctgtgctgccccggctggtctaaaggacaacctcctccacctggcctgaagccttctagcctggcttctcaggtggccagaaccacaggcgtgtaccagcacgtgtggctgatctgcttcgtgttcttcgtgtgcgtggaaaccggcttctgtcacgtggcccaagtgggactcgagagactggtgtctctgagcggcatcaccgacgtgaaccattgggcccagcctaagccatctcctagcaaaggcaccggcatgaacagacccatcggcctgagagttggcaaaggcgtgtgggccagactgagagcctccgtgtctttctggaccctgctgcctacaacaggcgtgcggacaagaggaagccctctgagactgacactgtggcctccacggaacatcctgaacagcctgcctagcagcatggaaatcgccgtgctgcaagagaaccgcaagaccagaaaggccgccagagagaagcacagaaagaccgacaacctgcacctgtgctactaccacagccagagcaaccggaacaagagccggcagatggaaagcctgggcatgaagctgcagagccctctgtgggattgctccaccacaacaggcacacaccacggctgtctgtgggagatccctagcgttacactgctggcctgcagagtgaacgccgtggaagaactgcacagcaggcggatgtctgtgcggatcgtgaagaactgggtgtcctgctgttacgtgcgcctgtctgctgtgggcctgtctacttggagcgccctggacgtggtcatcaacctgaagcggctgcagaagttcagccagaagtctcagcaccactgcgccctgagaaagatcgagtgggccacaaagctgagcctcggcggaaaagctggaccccaggctcaagagaaggccaacgccaagaagatgcccttccagcggtggatcttcagcaatcagctgaccgtgcagatgctgtgcctgcctattgaagccctgactgccctgttcacctgtcggacagccagcatcagcgtgaacatcagcaccctgatgagcatcctggaagcccctctgttttttcacggcgacctgtgcgaggaaaagaagaacggccggatcagcagccaggctcctctcagactttggtcttggtgcggcacaagccagacctactttggcagcaccgccaagaaaagccccaccagcttttgctgcgagtggggaggacaggctcaccggcagagaaataccggaatggaaatcctgctgtggattctgctcaagatggaaattcagatcttcaagatttgcctgggcgagatgcagctgtgcacctacacaccccacatctgcagacacacctgtagaggcggacctagcgccagcgatagatgctgtagctgtagccctagcggcttcagcgccggaagaggcagatgtccagttcagggatgtctgcggcctcacagagtgcagctgctgagaagatggggccctggatctcctgctggccagagactgtctaagggctttcagctgctccgttggtggggaccaggatctccagctcctgagcctagaaagggcccatttccaccacctgatcctccatggcctgtgaccgctgtgacagtgatggctggctctgtgcctagcgctcagtctgtggatgctctggaaagccctggacctctggcactggaaggacctagcagccccagaaacctgctctggcgggaaatgagcatcttcctgcctggcatcttcacctctcggattctgaacctgcaagtgctgaagaagatcctgcggagctttatgaagctgtaccactctctggtcatgtgcctgcggctgcggaccaagctggaaaaagctctgagcgctctgttcatctggccccagcacagctacaagcagaggcctcctctgcagcctgtgcaggtcgtgctcagactgggaaacctgcctccattcttcagaggcagcgaggtgccctttcctagaccttgccggaccaagatgctgaaccagaagtgtctggcccctttcatcacacacccattcgcctctcagcccctgggacaagagatgcccaacaacacccagatcagactgctgaagcccctgctgacccctgacaccagatggatcttctccaaccagctgcagacagtccagatgctctgtctgccacctctgaagcagggcgagagaatcatttggcccctcggcggctttcagatccccaacttcttttggagcctcggaatcggccacactggcgcctggtggcatactggaaggcggagaagagaatggggcggctccaccgtgtctagaagcccactgtggatcagctccatgatctacctgagaggcatggccttcgccagcgacagctccatcagaaccaccagagtgtcctggtgcagaagatgcggcgccaaatctgccgctgcctccagcctcaagaagaaaccccgggacatctgtcggatcagcgactctaagaagatgacccagaagcgcgagagcaccctgggcaatttctggatgaagctcctccagctgccagacaagaagaagaagtctaccgaaaagaccaagatcatcaagaagatgaagaaacggatcatggtccacatgtgcagctccctggctctgccaacaggcctgacatctctgatcctgccaagcagcgatctggccgtgctgatctctagctccaccagccactttctgatgcggagcccagtgctgcctagctccagactgacttgtgcctctccacagctgcccagaatgtggacctggtccagctggctgaagtggctgaaaaactggaagcggttcaagcttaaaaagaagtacatcctggccatgacgctgaccctgaacgggcatccaagaaccgcctctatcaccctgcctaccaccagcctgaagggctctagaaccagctgttgccccagatctcaccccagactgcctaggacaaagtggcctctgcagtgcctgctgcacagcctgggaacaactggaacactcgtgtgggaaaggggcgtgctgcagatgagaagtctggaagctcactgccctctgcagaccttccacctccaccactgtagaactcagcccagctcttgccctcctgcatggattctgtaccaaggacagtggagcggagccgtcgtgggacttagacctgtggctcaccatctgccaagacctattcagggcctgcactgcccacaggctccacatcaaccagctctgtcttggggcaagtggcccgtgggaatgacaggacctgccagatgttgccggtggcctagacgggaactcaaaaagaatctgctgctcccctgccggtgcagacgcgagtatagagtgacaatgggccaagccttcggcagctttagcgccgactttagcgctccccaggtgttgaagaagaatcggaagcagaacaagattatctgcaagggccaccgcatcacaagcctgatcctgagctttcagcgcgtgaaacttaagaagaaagtcaacgcctgctctcccgcctgcacctctaaagcctggactcccagaaagctcgtggggagagccgtcagaagaaagggcatcatctgtatcaagaatatgttcctgcagcggaagggtttcctgaacctgagccacgtggaaaagttcgtgcctccttctcctcctctggctctcggccctagaatgcagctctgtacccagctggcccggttcttccctatcacacctcctgtgtggcacatcctgggacctcagaggcacaccccttgtcaaaagaaggtgccctccgctagcccatggggccttagaccatctccttgcctgagctggtcctccagaattgtggcccctggacacgccctgagctgtcggactagaagaagatggtccagcaagggctacccctacgatgtccctgactatgcgtcc

SEQ ID NO: 1131 - DNA, 5250 bp, Artificial Sequence
  Polynucleotide encoding the hINV- and HA-extended poly-FSP polypeptide 1A
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgaccgagatccagctgaccatgaacgacagcaagcacaagctggaaagccccgctctgaaacaggtgtcaccagcctctccacctactcagcagcctcagacacctcaggattctagacaggtgctggccctggccaagaaaaccctgacaaatgcctccagagccggacagtttcctgtgtggcggagaacaagcagaggcatgagcctgcagtggaagtccggcaatgcctgcacacctctgagatgccctagcagaagccctgccacattcctgacagccctgaatggctggcacagatctggcctgagagcccagatgcctagctcttggtctagcagcggcagaacactgaagctggcccctctgcaagtgaccaccactctgaagctgatcctggtcatgctggaaatcgtgaccgagcgctccctgctgtactccagaatgtgtctggtgcagatccccacacacacctgggagcccgattacttcgtgtccctgcctatgatgttcagctgggccacacagtcttttcccgtgggcgccgtgtttctgaccagacctgccattccttgctgcagctgtaccagccacagcaacccttggagccagagcaatcagcagctgaagtggacccctcacatcctgaagtccgccagcttcgacaagaaaggcttcgtgatcctgagccggcggagcaagattgaggcctctcctatcggctctatcgccagctctcctggacatcctctgggacctacactggccatcagattcatcagcgcccctcagcctagcagctctacagtgacagctgcccctagcggccagtactttatcgccaagaagcggatcaagctgcggcggaacaatatgggcggcaacagatccatctgcctgaccagaaagcgcaagagagagaagcggagccagaagtccaggcagaaccatctgcagctgaaaagctgcagacggaagatcagcaactggtccaagctgagaagcccctggatcttcaccaagtgcgagatctgcgtgaagaacaccgccatcctggctatcaccctgatcacccctcaggaccctcatctggaccctgtgtgtcaccctcatagaaggcctggatggaagggccaccatagagtggtgttctctcaccatcctagcggcagcacaaagagccactggcagcaaagagaacgcggaggcggcagacgcgagaagaagggatgtagagaacagcggaaggtggtcaagaacccctctcagcccgtgcctctgagaaacgatggcatcaccaacggcaacgactccaccagaagctgctccatcagcctgaagaaaagcctggaaaagatgcccctgatgcggagagccagacctaccagctgtagcacctgtagaatgtggtggaagggcaagaaacggcggaaagaaatcgtgcctatgagcctggcctgcagcatcaccgtgtcttttgtgggacagatcagcaccctggtgctggatgtgtctagcatcagccattggcggctgccctgtaaagtgaccgagagcagctccagcttcttctacaccagcgacaggacccctctgagcatcagcagaccaaccagcagagctagacagagctgttgtctgcccggactgacacaccctgctcaccaacctctgggcagcatgagcactagaagagagatgccaagccaggccacaccttctccacctggaccttggagagccgctctgggcaaagaagtgaagagatcccagagcaagctgcgcctgagaaacacaagccctggggagaagaacgatctccagctgttcgtgatgagcgacaccacctacaagatctactggacagtgatcctgctgaacccctgcggcaacctgcacctgaaaacaacatcactgcagcggccacctcggagcatcctgtctctgaatggaatctgggaagtgatgccccggacactggaaggctgcatcagcgtgaaggatcacagaaccagccagaaccacagcaagtgcatcaccgaatgtgtgcggactgccctgaacgtgtccaagaagagactgcctaagctgatgaagaagaaggacagcaccatcttcatcaacaaagtgcgccagaacttcaagcgcaacttcaagaagaagaaacccctcactttcagccccagcagacggatgactcggagaaccatgacaaccaccaaaatgatgatgatgcggcggaccaagcggagaaggcgcaaaaggcggagaatgaccatgatgaccagacggaccctgctgacaaagaaaacctgtctgacccctagaaccagcgccgccacaaaagctctgcctagacagaccatcagccagcggaggcctattcagaccccacctggaacatctctggccatctggggcagaacaagactgaccctgacaggcaccagatccagcggaacaagagcctctccttccgccgtgtgcctgtgttgttggacctgtccaagcagaagcttcccagccgcttctcctagtggactgagagcacctgttggagcccaggctcctcctgaagtgacactgagagcctcttgtgcctctagcgcctctaaagcctgtgctggactttggccttggggagcccaagttcgagttggagctggaacaggcggaggacctgcttgtgttcctgtggctgaagcttctacaggcgcatggacagctgaaggcgccgctggaacaagatgtagagcctctagagccccttgccgccaacttcctgctagctcccctaccaagtgtgaaatttgtgtgaagcgcagacggcggagaaagagaagcagccagtctagaagccccgtgcctaaaaagcgcgagaggatgatgctgcctgtgcgggccagaacagctagatctgcacttcctcagggcagagcacctctggaagggatgctgcttcctagagcactgcctagcctgctgagcagaatgcctgccagaagagagtcccggttttggctggctctgcaggcacttggactcagacctccacatctgcctagctgtcatcctctgcctcaactgttgggccctccacctcctcatcaggccccaatgacactgaaggccctggttaagacctggacacagttccgcaactaccccagagccgacaagaagaatgtccggtctaccgccttcttcctgctggacatcatcctgggcgattgcccaagaacaatggccggaccttctgcctctctgcatcctgcatctggcagagcctccagaaagacctggcagagaaggctgagagcttgtagagcaggcggacctgctggatgggctagacaggcctatcctagactgaaaaccttcggcgtgcccctgggctctattctgtgtctggccggcagcctgtccacaatgatgatcattagcaccaccagacaagagtgcggcaggcgggcttctgtgccttgtagacctatgatcggaagcgccagaccaggaccttggcggacatctgctatgcctagtgccatgggagtcgccctgcctacctcttgtgaaagcggaagatctcctcctgccaccggcggaagaatgccaggatctcagtctatcatgatgagctggatgcctccactggctccatgtgccgcttgtccatgttctcccgctcctacactgtgcccagcacatcctgctagagcaccaacagccgtgcctgcctttacacctctgtctgctcatcctgtgccagtgctgtctggatgtcacctggccgtcagaacctccatgctgacactgctgcccatggaagccaaaaagagcatgaagcggtccaacgctaagaaaatggaagatatgatctgggagagccggctgccactgaggccacaaagaggacctagacctctgcacagatggctgcagcagacaaccggctgtagccagaggcggatcgtgttctttctggccccatacttccctcggcaccctcacagatctccaccaacatcttgcccacctctgctggaagctttcccactgccaagagcttctctgagggccacagtgccaagacatagctctgttctcgccaccggtctgcacctccacagacagatttctctgcccctgagaggattcctcctgcaccaaccactgccaggacagcatctgtggctgtctcacagactgaggctgagactgcccaggacacagccatctttgcctggaccatgtgcaagcctgctgtccacactgtctcagccaccacctcaggctccatctcaagtgtggactgccgctacactgagatgtcctgctgttcctgcagctgcctgtcctcctgctctgagatccatgcctaagagccggaaccaggtgctgttcagacggaatctgaccccaagccagctgagaacactggccccaccttatatgctgctgccccagtctctgtcccagagcctgagtagaaagcagatccctagccagtccatgctcgtgggctacccctacgatgtccctgactatgcgtcc

SEQ ID NO: 1132 - DNA, 5232 bp, Artificial Sequence
  Polynucleotide encoding the hINV- and HA-extended poly-FSP polypeptide 2A
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgagaaagatgcagagcctgaatcaccccagcagactgaccaatggctctcctccactgcacctgtgccagcctctgagaatgagcagaacccctcctagaagagtgtgcgccgctcctccacatagactgctgggcccttccagatggaaccctcggagaaagacctggaagatgcggaagaagtacgcccagaagcctagccagaagaaccacctgtacggcggcaagaagcgctctaagttcagcagaagccacctggacttcagcccctactggatgaagaaagtgaaggtgctgttcaaggccgaccagagcgagtctagcctgagcagcggaagatgcagcctgatggaacagatccctcacctgaagtctcggcggaagtggcagatcagacacgtgctgaagaacctgtggctgcccatgagaagcctgggagaaccttggagagccggctttcagtggggagagtctccttggcaagtgatggcctctctgaccggcagagccacatttctgctggccctttgggaatgtagcctgcctcaggcaagactgtgcctgatcgtgtctagaaccctgctgctggtgcagagccggaacaagaaaacaaagctgtggttcagcctgatcaacatccaccaccggaagaacccactgctgcctatgagatggtggtgtaccagaggcggcggaaagcggaaaaagaaaatgtgcaaggtgtccggcggctgcaccgcctgtgttgagagatgtccttggaagggcatctgctggaagtggcctgtgacagtggccgccattagaatgtgtgccctgtctcaccctagcttctacatcagcagcaccgtgtgctttctgagcaagcactgcatgaccgcctgcaccagaaagagaatgaagaccggcgccatccaagagaagggcgctattcaagagaaaggggccatgaccaagcggatctgcgtggtcaatttcgaggcctgcagagagatggaaagcctgagcgcccctgagaagatcaccctgtttgaagcccacatggcccggtgcacctccatcaatgtgctgtgtgtgcgggccagcctgattgagaagctgatgaaagaaaagcgcaagatgaagcggaaccaggtggcctctccacagatcatgcagcggctgttcatcaagggctaccagaacaaccacttcaccttccatctgcaaaacttcgccttcttcagctccttcggcaacaacaagtacatcaatatcctgaccatcctgttccacgtgcggaacatcgtgtacggcatccaagtgatgctgtgcgctagccctcagattatgcagagaaccagcgccgaccggttccggatgaagagaagaatgcagaatctggacaacctgggcgtgccatggcctctgttgcctggaatcccatctctgaacgcccagtggatgttcctgagaatcgcatccccgcaaatcatgcagaggatgagcgccgtgaacttcgagacaatccgggccagaaaccggaacatgaagaaaaccatgagccacctgatcgcccatcaggccctgaagatgagcggcctgagactgtttcaccccagactgctgacacggaagaagcccggaaaactgctgctcgcccatatgtacggcttcagcacctacggcacccagaaaggcgagtgcgtttgtctgcagtgtctgagcggcagcagcctgttcattctgaagcagcccctggacctgaagatcagcaagaccttcatgggccacagagagggcagcgagtctgataatctgggcctgctgtatagcttccctccaccttatcctatcagcgagggcctgaccatgaccaccggcagaaacatcaacagcaactccctgatgaccaactgcctgttcagccccatcttcctgtgccaccacgccatcatgcacagaaagatgacaagccctcacttcaggctgttcagcagcaagatcccacatcctcaggtgccatctgtggtggccctgtgcaagttccgggccttcatccacacacctagaagccctggctgcagcgtgtacgccaatatgtgctggcccaagttcttcctgaccttcagccagcagtggtccagcgtgacatctctggaatggacagcccaagagagaggctgcagcagctggctgatgaagcagacatggatgaagtcttggagcctgcgggaccccagctacagatccatcctggaatacgtgtccaccagagtgctgtggatgcctacctctaccgtgctgcaggctcatccacaagttccagctctggctcctcaagcctggtggcctgctagaagaggacctctgacatctgccccatccgctcagcagtccctgaccagagagaagattatcaaccccaccatcagctgcccctttcagagccccaccaagagactgatctaccctcctagcacctgttctctgccctgcagaggcttcctgcctagcagatttccttggggcccacctcctctgaacagcgtgatcgtgcacaagatcgtgctggtgttcctgaagtccctgtccagctacaactgcgagcggagaatcagcggcatccagaagagagccatcgagttcgccgtgctgaaactgctgaatatggacctgcctctcgagaacacacagatccccagaacaagcccactgtggaagatcacaatggtgctgacataccccaactgcgtggtgcatgtgctgatgtttggcgccctgagagccacagctcctgctacagctgcacctcaggctcagacccctcattggagagctgccacaacaagcagcatgagcagcagccctagagccgagcctacatcttctagctcttgggccacctgttggcccagatgctgctccagctcttgttactggtcactgtctagctggcctccagctggcgccgctgaagctacaaataccagaaccagaagccgcgagagccagaggggtagaatgctgacttggagaagctccctgtggttgcagggcaccagatgttttacaggcgtgcggaccagctccagatacaagaaaagaggcgtgatcgcctggcggagacagatcaatagacggaagctgcagagaaagaagcactggaacagcgcctacctgggcagaacactgctggtcacctgtatcctgtatcaccggtggatcgtgacctccatgtgtcagtcccagagatggctgaccagcaccacaagtagatctagcgccctgatgtggaccgagctgagcctggaaccatggattccctacctgcatcagcagaaaacccagcggacactggaatccgccggactgtttccttggctgcacacccagtgccaagagaagaaaagcagaaagctgatgtccagctgcacacacccctgcacaatgctgctgccacagggatgtcatcctgcctggctgagccctatctctgcctgtccaagactgctgccatatccttttcacgtgctggctctggaagtgacctttcctcctggaaccgccatgcctcagatgcagttgcaggctctggctatgtgggagaaaggctgggataagcctggcaccagcctgcagtgctacctgaacagaagaagaaacagccggaagcagagccaggtgcaactggccattcaggtgctgctcgtggacaagcacaagtactttctgttcggccaaaagaaaggccacatgatctttagcctggccaacggcctgtggtttaacctgattttcaactcccggaagaaactgctcgaggacatgaagcaaaatggcttcaccggcaaaggcctgacacaccccgtgcctctgaagcggactctgcagaacaaaagaaacaagaatatcaaacgcgtcaaccagaagaagggcaacatcaagcggaagtccatcctgctgcacctgattgtgctgaatagccccgagagcaacctgatcctgatccagcatggcggcatcttcacctttcggttctgggtcgagaagctgtcctggaacatctgcaagaacctgagcctgtacctggacaagttcgtgcagagactgctgtacgtgtacatcatcgagacaaacgtgttcgtgctgaacctgtttcatgtgcccgtgaaccagatcttcatgatggccttctacctgaagtacaccgagaaggcctgggtcatggaactggaatggctgatccaacagcagtgctatcagggcagctgcggcagagcttgttcttgtggaagaggctgtggcacccctagaggcgattggaagagacatcctcctcggagagccttctggaagcctcctagccagggcatctctagctgtctgatgaccggctgttggctcgagaagaaagctacctggatgcggcggacccgccggaagaagagggaagatcattgcggactgagacaccccagctggccttggacaagatgtctgaggatgaggcctccaagaagcggctacccctacgatgtccctgactatgcgtcc

SEQ ID NO: 1133 - DNA, 5247 bp, Artificial Sequence
  Polynucleotide encoding the hINV- and HA-extended poly-FSP polypeptide 3A
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgggagctgctgctgcctcttgtcagtctcctccttctcctcgggaaaccacacctagctccgacgccaccagacggacaagacctattgccgctcagagcaagaaaaccatgacagccgccggactgacccctatgatccggaagatccagaagcggcggagaaccgccaaccggtgtctgagagttagatgtggcggctggctgtgtggctggacacctagaggacagaacaccagaagcaccaacctggaaaagaaccccagcctgaagaagcagagccagcggagaggaaagctgagcagcctgttcttcagccactgcctgtgccggaacagcagaagggccacacctacatctaagggcagcctgcggcggaagtacctgagagtgcctattcctccacacctgagacaccctctgctgctgatggacctggacggaatgctgaccgtgatcggacagggactcgtgggcatgacccctagagatctgggaacagtggctggcgccaccgctcagattcagaggcctattcaggtgcagaccggcggcagacttacacctcctcctctgattctgtggcctcaggccgctcctgttgatcctcctggctctgtgtggattctgccctgcaagaacaagaagcggagaaagctgcggcccaagcggctggactttcaccctagatcttctagcggcgtgtccgtgatcaccatgaagctgtgggagaagcacttcaagggcctgaactggaacctggtcgtctggattctgaacctgaagatgatgaacatcgagatcacccctcagcggagcaaggccagaaagtccggcgtgatgaagtgctgggatctgtgccccagcgagaagaagaggaagctgcctctgcctctgaccttcagcaccctgctgtgggactctagacatagaggcgccagctccagcaccagcagagactccagaagctttttcaccagcgctcaccccagcagaccctgcagaatgagactgtaccagttcctgatccacctgagaaaggtggacacccaccatctgcaggtcgtgaccaagaccgtgacagccacaacagctgacggccagagaatgcggagactgaagtgcaaggcctgccggctgagatgggctagacctgaacctgctgctcaggcccctccaaagagccactttccacctcatcctagcggccctagcagaaccagttctctgcagctgcggagcatccctcacgtgccaaaagccacagccgctcacagcgtgacagtgaagctgcagaagggaaagaacagcccctgctgccaaaagaaactgcgggtgcagaatcagggccatctgctgatgatcctgctgcacaatacctacatggaaatgcactacggccatcaggccccacaggtggccatgctgcctaagctgctgtgcagacagatgctgcccactctgagcacactgcagcaaagacacccacagggcccttgtcctccacctgtgacaccactgagagtccagtctgtcctgctgctgggagtgcctcagacagctgctagacagcctagcagacccaccggcagaacccctaccacaagactgatggcccctgtcggcagcgtgatgagctgttctctgctgacccagccttctccagccagcgcctgtacaatgcctccactgctgcatcctcagtgggccccacattctgctggattgtctcccggcgcttgcagacctgcctgtacctgtatcagcatgaccaccatctccagagccacctggcaggtttccgtgtacagcggcaatctgctgagcttctccagacggggcatgaagagtagcgtgcggctgaaaaacagccggcggaacagacggtacagaaagatctacggcgagctgaagatgtccctgcaggccgtggctcctagatgtcctagatctgccgtggacatcagccccggacctacctctcctagcctggcctcttgtgcctctgtggccattggaaaactggccctgcttggcgcttctgccccttgtggtgctgctggcgctagagaggctggaagatttgccgtgctgggcaccatggtcatgaagcacctgaaccgcaagctgcatctgacccggtcctgcctgatcgatctgaccatgatgatgagccagaagctctggaagaaccagcggaagagaatccctctgccatctcctagacagcatctgctccctcagtaccctctgcaccctcctccaccttgtctgctgctgctccaccacagacaccacctggcctttctggaaatggcctgcagcagccagcacacccactccatcaagatctggatcagctttagccacgagcagagcagcccattcctggccagatcctggaacaccatgcagtggaacaacaagaaaatggccatgacagtgatcgctggcgcccaccactgtcagtacaagctgacctacaccaaagtgtggaagatgaattggaagaaaatgatgatcggctcccagcacctcctgttcagccctctggatagctctccactgcaactgctgcttcaccctcacggcaagagatgcaacccttgctgcagactgacatggatgtccatgctgcagaaacagtgctgctacaacctcgtgatcaagcacccactgatcttcagaatcaacctgcggagacagggcaagaccaaggatggcgttgtgcagagcctgggcttcctgaaccagcagatcatcctgcagaaagagttcttcatctgcctgctcatgtttatcaagcggtggaagcctgccgccaccaagagagagtgggagaaacgcaagcagatcctcggcggaggcggcaagtacaaagagtacttcctgaagcgcatcctgattcggaaggccatgactgtgctggccggcgacaagaaaggcctgggcagattcatgagatgcgtgcagagcgagacaaaggccgttagcctgcagctcccactcggaagaggccctgtgtactacgtgtgcaaccggatgaacgtgtccagcgtgctgaagcccttcctgttcaccgtgcctatcgaggacatgagagagtgcacactgggccgcaacagaatgaatgtgtcctctgtgctgaaaccctgtctgatccctgtgccaatcgacctgcctcggatgctgccaatcagcagcccactgcacagaccccagatgccattctggacctgcacctttcctgccacaacatggggcacctgggagacaccttctacatggggctggcggacctttcggggccctagaagaaaagtgctgatggtgctgtggctgcccgccaaccagagtctgcagaaaagccaagtgttccagtgggtcctgcggaccgagaacatccggaagctgatctggaccaagcagcggagcttcctgtctctgttccccaagctgagagccaccgaacagatgaccaatgtgggctgcgccttcagcggccggattctgcatcaacctgaaatggccgccatgcggctgatgcccaagttcctgaatagcaccaacagctggtggacctgtaccaacctgagcgtgcccatgatgctgaccattctgatttggaagcgggtgttcattctcctgctgtccgacaagaagctgctgaagaagtctagccagctgaggcggtcttggagaaacgtgtcccggatcagccaccagatgaagtgtctgaccgccgtggactgtctgcaggccttctgggacatgaacatggaacaccggctgaccatggacagcgccctgagcctgacaaagagagagggacccgagacttgcaagaagaagctcctgctgaaactgctgacaatgagcctgagcaacatcctgatgaagttccggctgcggctgagaatcccaagcctgaggaagtatcgccagcatctgaaaaagaccagcgccaagggcgagaagctgaagcactgctttaaggcttggggcagaggcccacctctgcacacaagaagccagaagaaagaccctgccggcaagctgaaaaaactgaccacactgagcttcgtgctgatcgaggaacggcggaacctgcagcggaatctgaaagtcctgtggctcaagaaaagcaccaagagccggtatctgttcttcctgaccgtgtgcggcttcttcgagaagaaacggcctgagtggctgtcctccagaaagaagggacacacaaagaatcggaggaaggccaagcggaagccccagatcgtgcacaagaagagaggcctgttcctcaaaaagaaatacctggtgcagggcgccaagaagatcaccttcctgtccaacggcatggaagcttgcggcacacaccccacaccaagactgagcgacagagtgttcctggtcaagatcaccaccaccacaagcagccccagaagaagcccagcactgagagctagaggcggcaccacaattggcgaagtgaccagcctgtgcttcttctacctgctgtacggctacccctacgatgtccctgactatgcgtcc

SEQ ID NO: 1134 - DNA, 5250 bp, Artificial Sequence
  Polynucleotide encoding the hINV- and HA-extended poly-FSP polypeptide 4A
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgatccagaagaagaaacagaaatccatggccaagaagtcccagcagcctctggtgctgaagaagaaccggaagcaagagtggggaggacaggcccacagacagagaaacaacgccaagaagatgcccttccaagaggaaaagaagaacggccggatcagcagcagcctgatcctgagcttccagagagtgaaggacagcaagaaaatgacccagaagatgtgcagctctctggccctgcctacaggcctgacatctctgatcctgcctagcagcgatctggccgtgctgatctctagcagcaccagccactttctgatgcggagccctgtgctgccaagctccagactgacatgtgcctctccacagctgccccggatgtggacatggtctagctggctgaagcaccccagaaccgctagcatcacactgcctaccacaagcctgaagggcagcagaaccagctgctgcccaagatctcaccccagactgcctaggaccaagtggcctctgcagtgtctgctgcacagcctgggaacaacaggcacactcgtttgggaaaggggcgtgctgcagatgagaagcctcgaagcccattgtcctctgcagaccttccatctgcaccactgcagaacccagccaagctcttgtcctcctgcctggattctgtaccaaggccagtggagcggagccgtcgttggacttagacccgtggctcaccatctgcctagacctatccagggcctgcactgtcctcaggctcctcatcaacctgctctgagctggggaaagtggcccgtgggaatgacaggacctgccagatgctgtcggtggccccgcagatctcagaagtctcagcatcactgcgccctgcggaagatcgagtgggccacaaaactgtctctcggcggaaaagccggaccacaggctcaagagaaggccagaccttctccttgcctgtcctggtccagcagaattgtggcccctggacacgccctgagctgtcggactcgtagaagatggtcctccaagtgcagaggcggccctagcgccagcgatagatgttgtagctgtagccccagcggcttcagcgccggaagaggcagatgtcctgtgcagggatgtctgaggccacacagagttcagctgctgagaagatggggcccaggatctcctgctggccagagactgtctaagggcttccaactgctgcgttggtggggacctggatctccagctcctgagcctagaaagggcccatttcctccacctgatcctccatggcctgtgaccgctgtgacagtgatggctggctctgtgcctagcgcacagtctgtggatgccctggaatctcctggacctctggctctggaaggccctagcagccctagaaacctgctgtggcgggaaatgagcatctttctgcccggcatcttctgccaaaagaaggtgccatctgccagcccctggggacttgttcctccttctccaccactcgctctgggccctagaatgcagctgtgtacccagctcgccagattcttccccatcacacctccagtgtggcacatcctgggacctcagagacacacacctcaggtggtcctgagactgggcaacctgcctccattcttcagaggcagcgaggtgccctttcctagaccttgccggaccaagaacgagggcaacaatcactggcccagagtggaaatgcctaccggctggctgctcgtgggctacaacaccagaaacacagcccagaatcctcggctgcagcagcatctgaaacactggcagcagtgcacacgggccagatggtgtcaagagccttgtcagaccctgaccttcttccacttcttcttctttttcaaaacggtgtccctgtgttgtcccggctggtccaaaggacaacctccacctcctggcctgaagccttctagcctggcttctcaggtggccagaaccacaggcgtgtaccagcacgtgtggctgatctgcttcgtgttcttcgtgtgcgtggaaaccggcttctgtcacgtggcacaagtgggcctcgagagactggtttctctgagcggcatcaccgacgtgaaccattgggcccagcctaagccatctcctagcaaaggcaccggcatgaacagacccatcggcctgagagttggcaaaggcgtgtgggccagactgctcaagaagaagcctagagacatctgtcggatctccaacagaaagacccggaaggccgccagagagaagcaccgcaaaacagatagagccagcgtgtccttctggactctgctgcctacaacaggcgtgcggacaagaggaagccctctgagactgactctgtggcctcctagatgcagatgcagacgcgagtacagagtgaccatgaacatcctgaacagcctgccaagcagcatggaaatcgccgtgctgcaagaaaccgccaagaaaagccctaccagcttctgctgcaacctggacctgcagcatcagcgcagacgcaaaaagaagaaagacaaggtcgagatccggaatcggagccccaaggccaatagcacagagtgtcagggcgagcacagcagagagcagaatctgctgaatctggtgcagctgaatcctcacagccctcaccaccggaaggacgaagaggaccaccagaagagacaccaccaccacaatcaaaagaagatgagcgtcccactgttcttccacggcgacctgtgtagagagagcaccctgggcaatttctggatgaagctgctccagctgcctcagaggcctccactgcaaccagtgaccggaatggaaatcctgctttggattctgctgaagatggaaattcagatcttcaagatttgcctgggcgagatgcagctctgcacctctcggattctgaacctgcaagtgctgaaaaagatcctgcggagctttatgaagctgtaccacagcctcgtgatgtgcctgcggctgaggaccaagctggaaaaggctctgagcgccctgttcatctggcctcagcactcctacaagatcacacacccattcgccagccagccactgggacaagagatgcccaacaacacccagatccggctgctgaagcccgacaagaagaagaaaagcaccgaaaagaccaaaggccaggctttcggcagcttctccgccgatttttcagcccctcaaggacaggcttttggctccctgtgtcagctggtgtccgccgactttagcgccccacaagtgaccagactgcggagcctgaaccatctgctgatttggctgaagaattggaagcggttcaagctcaaaaagaaatatcaggcccctctgcggctgtggtcttggtgcggaacaagccagacctacttcggcagcatcatctgtatcaagaatatgttcctgcagcggaagggtttcctgaacctgagccacgtggaaaagttcgagcttaagaagaatcttctgctccccgtcgtgatcaacctgaagagactgcagaaattcatgctgaaccagaagtgcctggctccatttcctgcctgcaccagcaaagcctggacacccagaaaactcgtgggcagagccgtgcggagaaagggcattctggccatgacactgaccctgaacggaatcgaggccctgacagccctgtttacctgtagaaccgcctccatcagcgtgaacatcagcaccctgatgagcatcctggaagccatcatcaagaagatgaagaaacggatcatggtgcaccggtggatcttctccaatcagctgaccgtgcagatgctctgcctgcctctgctgacccctgacaccagatggatctttagtaatcagctgcagacagtgcaaatgctgtgtctgccacctctgaagcagggcgagagaatcatttggccactcggcggctttcagatccccaatttcttctggtccctcggcatcggacacactggcgcatggtggcatactggtagaaggcggagagagtggggcggctctaccgtgtctagaagcccactgtggatcagctccatgatctacctgagaggcatggccttcgccagcgacagctccatcagaaccaccagagtgtcctggtgtcggagatgtggcgccaagtctgccgcagcctcttcttctccactgtgggattgcagcaccacaaccggcacacaccacggatgcctgtgggagatccctagcgttaccctgctggctaacctgcacctgtgctactaccactctcagagcaacagaaacaagagccgccagatggaatccctgggcatgaagctccaacttaaaaagaaagtgaacgcctgcagcacctacacaccccacatctgcagacacacctgtcgcgtgaacgccgtcgaggaactgcactctagaaggatgtccgtgcggatcgtgaaaaattgggtgtcctgctgctacgtgcggctgtcagctgtgggactgtctacttggagcgctctggacaacaagatcatctgcaagggccacagaatcaccggctacccctacgatgtccctgactatgcgtcc

SEQ ID NO: 1135 - DNA, 5250 bp, Artificial Sequence
  Polynucleotide encoding the hINV- and HA-extended poly-FSP polypeptide 1B
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgaccgagatccaattgaccatgaacgacagcaagcacaagctggaaagccccgctctgaaacaggtgtcaccagcctctccacctactcagcagcctcagacacctcaggatagcagacaggtgctggccatgcctagcagctggtctagctctggcagaacccagcggaaggtggtcaagaatcctagccagcctgtgcctctgagaaacgacggcatcaccaacggcaacgactccaccagaagctgcagcatcagcctgaagaaaagcctggaaaagatgcccctcatgatgaagaagaaggacagcaccatcttcatcgtgcccatgagcctggcctgtagcatcaccgtgtctttcgtgggccagatcagcacactggtgctggatgtgtccagcatctcccactggaacaaagtgcggcagaacttcaagcggaacgccgacaagaagaacgttcggagcggcgagaagaacgacctgcagctgtttgtgatgagcgacaccacctacaagatctactggaccgtgatcctgctgaacccctgcggcaatctgcacctgaaaaccaccagcctgggcgactgtcctagaacaatggccggaccttctgcctctctgcaccctgcatctggcagagcctctagaaagacctggcagagaaggctgagagcctgtagagctggtggacctgctggatgggccagacaggccttcgataagaaaggctttgtgatcctgagcgtcggagccggaacaggcggaggacctgcttgtgttcctgtggctgaagcttctacaggcgcttggacagctgaaggcgccgctggaacaagatgtagagcttctagagccccttgcagacagctgcctgccagctctcctaccaagtgcgagatctgcgtgaagcgcagacggcggagaaagagaagcagccagtctagaagccccgtgcctaagaaacgcgagagaatgatgctgcccgtgcgggccagaacagctagatctgcacttcctcaggggagagcccctcttgagggaatgctgcttcctagagcactgcccagcctgctgtctagaatgccagccagaagagagagccggttttggctggctctgcaggcacttggactcagacctccacatctgcctagctgtcatcctctgcctcaactgcttggccctccacctcctcatcaggcccctacagctttcttcctgctggacatcattctgcggctgccctgcaaagtgaccgagtctagcaatatgggcggcaacagatccatctgcctgaccaacgccaagaaaatggaagatatgatctgggagagcacgcccctgagcatcagcagacctacatctagagccaggcagagctgttgtctgcccggactgacacatcctgctcaccagccactgggatctatgaccctggccatcagattcatcagcgctcctcagcctagctccagcacagtgacagctgctcctagcggccagtacttcaagggcaagaagcggcggaaagagatcttcaagaagaagaaacccctgacattcagccccagcctggccaaaaagaccctgaccaatagcagcttcttctacaccagcgaccgcgaggccaagaaatctatgaagcggagcatgaccctgaaggccctggtcaagacctggacacagttcagaaactaccccagagcctcctctcctggacaccctctgggacctaatggcatctgggaagtgatgcccagaacactggaaggctgcatctccgtgaaggaccacagaacaagccagaaccacagcaagtgcatcaccgagtgtgtgcggacagccctgaacagaagaagcaagatcgaggcctctcctatcggctctatcgccctgagatccatgcctaagagcagaaaccaggtgctgttcagacggaatctgaccccaagccagctgagaactctggcccctccttatatgctgctgccccagtctctgagccagagcctgagcagaaagcagatccctagccagtccatgctggtggcctctagagcaggacagtttcctgtgtggcggagaaccagcagaggaatgagcctgcagtggaagtccggcaatgcctgcacacctctgagatgccctagcagaagccctgccacattcctgacagctctgaacggctggcacagatctggactgagagcccagagaaagcgcaagcgcgagaagagaagccagaagtccaggcagaaccatctgcagctgaagtcctgccggcgcaagatctccaactggtccaagctgagaagcccctggatcttcgtgtccaagaagagactgcccaagctgaccaagtgtgaaatctgtgtcaagaacaccgccatcctggctatcaccctgatcacccctcaggaccctcatctggaccctgtgtgtcaccctcatagaaggcctggatggaagggccaccacagagtggtgttttctcatcaccctagcggcagcaccaagagccactggcagcaaagagaacgcggaggcggcagacgggaaaagaagggctgtagagagagatccctgctgtactccagaatgtgcctggtgcagatccccacacacacctgggagcccgattacttcgtgtctctgcccatgatgttcagctgggccacacagtcattccccgtgggagccgtgtttctgaccagacctgccattccttgctgtagctgcacaagccacagcaacccttggagtcagagcagacacccacacagaagcccacctacctcttgtcctccgctgctggaagcctttccactgcctagagcatccctgagagccaccgtgccaagacatagctctgtgctggcaaccggactgcatctgcacagacagatttctctgcccctgagaggattcctgctgcatcaaccactgccaggccagcatctgtggctgtctcatagactgcggctgagactgccaagaactcagcggcctcctagatccatcctgagccttagactgccactgaggccacagagaggacccagacctctgcatagatggctgcagcagaccacaggctgtagccagagaagataccccagactgaaaaccttcggcgtgccactgggctccattctgtgtctggctggatctctgagcaccatgatgatcattagcaccaccagacaagagtgtggcaggcgggcatctgtgccctgtagacctatgatcggaagcgccagaccaggaccttggagaacatctgctatgcctagcgccatgggcgtcgcactgcctacaagctgtgaatccggaagatctcctcctgccaccggcggaagaatgcctggaagccagagcattatgatgagctggatgcctcctctggctccttgtgccgcttgtccttgttctcccgctcctacactgtgtcccgctcatcctgctagagcacctacagccgtgcctgcctttacacctctgtctgcacatcctgtgcctgtgctgtctggatgtcacctggccgtcagaacctccatgctgacactgctgcctatgctgaagctggccccactgcaagtgaccaccacactgaagctgatcctggtcatgctggaaatcgtgaccgagagcactcggagagagatgccttctcaggccacaccttctccacctggaccttggcgagccgctctgggcaaagaagtgaagagatcccagagcaagctgcgcctgagaaacacaagccccatcgtgttctttctggccccatacttccccagacggatgaccagacggaccatgacaaccaccaaaatgatgatgatgcggcggaccaagcggagaaggcgcaaaaggcggagaatgacaatgatgacaaggcggaccctgctgacaaagaaaacctgtctgacccctagaaccagcgccgctaccaaagctctgccaaggcagacaatctcccagcggaggcctattcagacccctcctggaacatctctggccatctggggcaaccagcagctgaaatggacccctcacatcctgaagtccgccagcagaagggccagacctaccagctgtagcacctgtagaatgtggtggatcgccaaaaagcggatcaagctgcggcggaacagaaccagactgacactgacaggcacaagaagcagcggcaccagagcttctccatccgccgtttgcctgtgttgctggacctgtccttccagaagcttcccagccgcttctccaagcggattgagagcacctgttggagcacaggcccctccagaagttacactgagagctagctgtgcctccagcgcctctaaggcttgtgctggactttggccttggggagcacaagttcggcaaccatctttgcctggaccatgcgcttctctgctgagcacactgtctcagccacctccacaggctccatctcaagtgtggacagccgcaacactgagatgtcctgctgttccagctgctgcctgtcctcctggctacccctacgatgtccctgactatgcgtcc

SEQ ID NO: 1136 - DNA, 5232 bp, Artificial Sequence
  polynucleotide encoding the hinv- and ha-extended poly-fsp polypeptide 2b
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgagaaagatgcagagcctgaatcaccccagcagactgaccaacatgagcagaacacctccaagacgcgtgtgcaaccctcggagaaagacctggaagatgcggaagaagtacgcccagaagcctagccagaagaaccacctgtacaacagccggaagaaactgctcgaggacatgaagcagaatggcttcacaggccacagagagggcagcgagtctgataatctgggcctgctgtactcctttcctcctatccggatgtgcgccctgtctcaccctagcttctacatcagcagcaccgtgtgctttctgagcaagcactgcatgaccgcctgcacacaaaagaaaggccacatgatcttcagccgcgagaagatcatcaaccccaccatcagctgcccctttcagagccccacaaagcggctggaactgagcctggaaccttggattccctacctgcaccagcagaaaacccaaggcggcaagaagagaagcaagttccctggcaccagcctgcagtgctacctgaacagatgcagcctgatggaacagatccctcacctgaagtccgcctctccacagatcatgcagagaaccagcgccgaccggttccggatgaagcggagaatgcagaacctggacaatctgggcgttccatggccactgctgcctggacctctggaaaacacacagatccccagaacaagccctctgtggaagatcacaatggtgctgacataccccaactgcgtggtgcacgtgctgatgttctggctgcctatgagatctctgggcgagccttggagagctggctttcagtggggagagtccccttggcaagtgatggctagcctgacaggcccctatcctatcagcgagggcctgaccatgaccaccggcagaaacatcaacagcaactccctgatgaccaactgcctgttcagccccatcttcctgtgccaccacgccatcatgcaccggaagatgacaagcccacacttcagactgttcagcagcaagatcccacatcctcaggtgccatctgtggtggccctgtgcaagttcagagccacatttctgctcgccctgtgggagtgtagtctgcctcaagccagactgtgcctgatcgtgtctagaaccctgctgctggttcagtctgccgctcctccacatagactgctgggcccttctagatggtccagaagccacctggacttcagcccctactggatgaagaaagtgaagctggccaacggcctgtggttcaacctgatcttcgtgctgttcaaggccgaccagagcgagtctagcctgtctagcggccggaacaagaaaacaaagctgtggttctccctcatcaacatccaccaccgcaagaatcctctgctgcccatgagaatccccagcctgaatgcccagtggatgttcctgagaatcctgcttctggcccatatgtacggcttcagcacctacggcacccagaaaggcgagtgcgtttgtctgcagtgtctgagcggcagcagcctgttcattctgaagcagcccctggacctgaagatctccaagaccttcatgctgcaagctcacccacaggtgccagctcttgctcctcaagcttggtggcctgctagaagaggccctctgacatctgctccatccgctcagcagtctctgacagctagccctcagattatgcagcggatgagcgccgtgaacttcgagacaatcatctaccctccaagcacctgtagcctgccttgtagaggcagaacactggaaagcgccggactgtttccttggctgcacacccagtgtacacacccctgtaccatgctgctgccacaaggctggtggtgtacaagaggcggcggaaagcggaaaaagaaaatgtgcaaggtgtccggcggctgcaccgcctgtgttgagagatgtccttggaagggcatctgctggaagtggccagtgacagtggctgctcagtggtctagcgtgacctctctggaatggacagcccaagagagaggctgcagcagctggctgatgaagcaaacatggatgaagtcttggtccctgcgggaccccagctacagatccatcctggaatacgtgtccaccagagtgctgtggatgcccacaagcaccgtgcggagaagaaacagcagaaagcagtctcaggtgcagctggccattcaggtgctgctcgtggacaagcacaagtactttctgttcggcagagcccgcaaccggaacatgaagaaaaccatgagccacctgatcgcccatcaggccctgaagatgagcggcctgaggctgtttcatcctcggctgctgacaagaaagaagcccggcaagttcctgcctagcagatttccttggggccctcctcctctgtgtcatcctgcttggctgagccctatctccgcctgtccaagactgctgccatatccttttcacgtgctggccctggaagtgacctttccacctggaacagccatgcctcagatgcaactgcaggccctggccatgtgggagaaaggctgggataagcggaagagaatgaagaccggcgccatccaagagaagggcgctattcaagagaaaggggccatgaccaagcggatctgcgtggtcaatttcgaggcctgcagagagatggaaagcctgagcgcccctgagaagattaccctgtttgaagcccatatggcccggtgcacctccatcaatgtgctgtgtgtcagagcctctctgatcgagaagctgatgaaagaaaagcgcaagatgaagcgcaaccaggtggcatccccacaaattatgcagaggctgttcattaagggctaccagaacaaccacttcaccttccatctgcaaaacttcgccttcttcagcagcttcggcaacaacaagtacatcaatatcctgacgcggcgcaagaaaagagaggaccactgcggactgctgatcctgatccagcacggcggcatcttcacctttcggttctgggtcgaaaagctgagctggaacatctgcaagaacctgagcctgtacctggataagttcgtgcagcggctgctgtacgtgtacatcatcgagacaaacgtgttcgtgctgaacctgttccacgtgccagtgaaccagatcttcatgatggccttctacctgaagtacaccgagaaggcctgggtcatggaactggaatggctgatccaacagcagtgttaccagcaagagaagaaaagccggaaactgatgagcagctgccgggccttcatccacacacctagaagccctggctgcagcgtgtacgccaatatgtgctgggccttttggaagcctcctagccagggcatcagctcttgtctgatgacaggctgttggggcagccctcctctgcacctgtgtcagcctctgaggcggtataagaaaaggggcgtgatcgcctggcggcggagaaagtggcagatccggcatgtgctgaaaaacctgatcctgtttcatgtgcggaacatcgtgtacggcatccaagtgatgctgtgcggcaagggactgacacaccctgtgcctctgaaacggaccctgcagaacaagaggaacaagaacatcaagcgggtcaaccagaagaagggcaacatcaagaggaagtccatcctgctgcacctcattgtgctgaatagccccgagagcaaccccaagttcttcctgacctttagccagctcgagaagaaagctacctggatgagaagaacaggcgccctgagagccacagctcctgctacagcagctcctcaggctcagactcctcattggagagccgccacaacaagcagcatgagcagcagccctagagccgagcctacatcttctagctcttgggccacctgttggcccagatgctgtagctccagctgttactggtccctgagttcttggcctcctgctggcgccgctgaggctacaaacaccagaactagaagcagagagtcccagcggggcagaatgctgacttggagaagtagtctgtggctgcagggcaccagatgttttacaggcgtgcggacaagcagcggaagctgtggcagagcttgtagctgcggaagaggctgtggaacccctagaggcgattggaagagacaccctcctcggaggaatagcgtgatcgtgcacaagatcgtgctggtgtttctgaagtccctgtccagctacaactgcgagagaaggatcagcggcatccagaagagagccatcgagtttgccgtgctgaaactgctgaatatggacctgcactggaactccgcctacctgggcagaactctgctggtcacctgtatcctgtatcaccggtggatcgtgacctccatgtgccagtctcagagatggctgaccagcaccacaagcagatccagcgctctgatgtggacccggcagatcaatcggaggaagctgcagagaaagaagaggcacccaagctggccttggaccagatgccttagaatgaggcctcctagaagcggctacccctacgatgtccctgactatgcgtcc

SEQ ID NO: 1137 - DNA, 5247 bp, Artificial Sequence
  Polynucleotide encoding the hINV- and HA-extended poly-FSP polypeptide 3B
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgggagctgctgctgcctcttgtcagtctcctccttctcctcgggaaaccacacctagctccgacgccaccagacggacaagaccaattgccgctcagagcaagaaaaccatgacagccgccggactgacccctaagaacaagaagcggagaaagctgcggcccaagatgatccggaagatccagaagagaaggcggaccgccaaccggcggaatagcagaagggctacccctacaagcaagggcagcctgagaagaaagtacctgagagtgcggggacctcctctgcacacccggaacatcagaaagctgatctggaccaagcagcggagcttcctgtctctgttccccaagctgagagccaccgagcagatgaccaatgtgggctgctctatccctcacgtgcccaaagccacagccgctcactctgtgacagtgaaactgcagctgcccctgaccttcagcaccctgctgtgggatagcagacacaccatgagcctgagcaacatcctgatgaagttccggctgcagtctagcccattcctggccagatcctggaacaccatgcagtggaacaacaagaaaatggccatgaccgtgatcgctggcgcccaccactgtcagtacaagctgacctacaccaaagtgtggaagatgaactggaagaaaatgatgatcggcagccagcatctgctgttcagccctctggatagcagtcccctgcagctcctgctgcaccctcacggcaagagatgcaacccttgctgcagactgacctggatgagccagaacaccagaagcaccaacctggaaaagaaccccagcctgaagaagcagagccagcggagaggaaagctgagcgcctttagcggcagaatcctgcaccagccagaaatggccgccatgagactgatgcccaagttcctgaactccaccaacagctggtggaccctgaccacactgagcttcgtgctgatcgaggaagccagacagcccagcagacctaccggcagaacacctaccaccagactgatggcccctgtgggcagcgtgatgagctgttctctgctgacccagccttctccagccagcgcctgtacaatgcctccactgctgcatccacagtgggcccctcatagtgctggactttctccaggcgcttgcagacctgcctgcacctgtatcagcatgaccaccatcagcagggccacatggggcccagtgtactacgtgtgcaaccggatgaacgtgtccagcgtgctgaagcccttcctgttcaccgtgcctatcgaggacatgagagagtgcaccctgggcagaaacagaatgaatgtgtcctctgtgctgaaaccctgtctgatccctgtgccaatcagcgagaagaagaggaagctgcccaacatcgagatcacccctcagcggtctaaggccatgctgcagaagcagtgctgctacaacctcgtgatcaagcaccctctgatcttcagaatcaacctgcggcggcagggcaagaccaaagatggcgttgtgcagagcctgggcttcctcaaccagcagatcatcctgcagaaagagttcttcatctgcctgctcatgttcatcaagcggtggaagcctgccgccaccaagagcagaaagaagggccacaccaagaacagacggaaggccaagagaaagccccagatctacctgttcttcctgaccgtgtgcggctttcacctgaaaaagaccagcgccaagtggctgaagaagtccaccaagtccagatccaacggcatggaagcttgcggcacacaccccactcctagactgagctgcctgagagttagatgcggcggctggctgtgtggctggacacctagaggtagaaagtccggcgtgatgaagtgctgggatctgtgccccgtgcacaagaagagaggcctgttcagactggattttcaccccagaagcagctccggcaagggaaagaacagcccctgctgccaaaagaaactgcgggtgcagaaccagggccatctgctgatgattctgctgcacaatgaccgggtgttcctcgtgaagatcggcgagaagctgaagcactgtttcaaggcctggggctccagacggaaccggcggtacagaaagatctacggcgagctgaagatgtccctgcaggccttcctgatccacctgagaaaggtggacacccaccacctccaggtggtcaccaaaacagtgaccgccacaacagccgacggccagagaatgcggagactgaagtgcaaggcctgccggctgagatgggccagacctgaacctgctgctcaggcccctcctaagagccactttccacctcatcctagcggccccagcagaacaagtagcctgcagctgagaagcctgttctttagccactgcctgtgcagccagaagaaggaccctgccggcaagctgaaaaagctgctgaagaaaagcagccagctgcggagaagctggcgcaatgtgtccagaatcagcacccctcctccactgatcctgtggcctcaagctgctcctgtgtccgtgatcaccatgaagctgtgggagaagcacttcaagggcctgaattggaacctggtcgtgtggattctgaacctgaagatgatgacctacatggaaatgcactacggccatcaggccccacaggtggcaatgctgcctaagctgctgtgcagacagatgctgcccactctgagcacactgcagcagagacatcctcagggcccttgtcctcctcctgtgacacctctgagagtccagtctgtcctgctgctgggagtgcctcagacagccagaggacctagaagaaaggtcctgatggtgctgtggctgcccgccaatcagtctctgcagaaaagccaggttttccagtgggtgctgcggacagaggtggcccctagatgtcctagatctgccgtggacatcagccccggacctacatctcctagcctggcctcttgtgcctctgtggccattggaaagctggcactgcttggcgcctctgctccttgtggtgctgctggcgctagagaggccggaagatttgctgtgctgggcaccatggtcatgaagctttgtttcttctacctgctgtaccggctgcgcatcccaagcctgaggaagtacagacagcacctgaaccggaagctgcacctgacaagatcctgcctgatcgatctgaccatgatgatgtcccagaagctctggaagaaccagcggaagagaatccctctgccatctccacggcaacatctgctgccacagtaccctctgcacccacctccaccttgtctgctgttgctgcaccatagacaccacctggcctttctcgagatggcctgtagctctcagcacacccacagcatcaagatctggatcagcttcagccatgaagtggaccctccaggcagcgtgtggatactgccttgcgatctgcctcggatgctgccaatctcttcacccctgcacagaccccagatgcctttctggacctgcacctttcctgccacaacctggggcacatgggagacaccttctacatggggctggcggactttcagaggcgctagcagcagcacatcccgggacagcagatccttcttcacctctgctcaccctagcaggccctgcagaatgagactgtaccagtgcaagaagaagctcctcctgaaactgctgaccaccaccacaagcagccccagaagatcccctgctctgagagcaagaggcggcaccacaatcggcgaagtgaccagctgtaccaacctgagcgtgcccatgatgctgaccatcctgatttggaagcgggtgttcatcctcctgctgagcgataagaagggcgccaagaagatcaccttcctgcctattcctccacacctgagacaccctctgctgctgttcgagaagaaacggcctgagtggctgagcatggacctggacggaatgctgacagtgatcggccagggactcgtgggcatgacccctagagatctgggaacagtggcaggcgccaccgctcagattcagcgacctatccaggtgcagactggcggcagactcagaagaaacctgcagagaaacctgaaggtgctccaggtgtccgtgtacagcggcaacctgctgtcctttagcagacggggcatgaagtctagcgtgcggctgaaaaaccgcgagtgggagaaacggaagcagattctcggaggcggcggaaagtacaaagagtacttcctgaagcgcatcctcatccggaaggctatgacagtgctggccggcgacaagaaaggactgggcagattcatgagatgcgtgcagagcgagacaaaggccgtgtctctgcaactgcctctgggaagaaacatggaacaccggttgaccatggacagcgccctgagcctgacaaagagagagggacccgagacactcaaaaagaaatacctggtccagcaccagatgaagtgtctgaccgccgtggattgtctgcaggctttttgggacatgggctacccctacgatgtccctgactatgcgtcc

SEQ ID NO: 1138 - DNA, 5250 bp, Artificial Sequence
  Polynucleotide encoding the hINV- and HA-extended poly-FSP polypeptide 4B
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgatccagaagaagaagcagaagtccaacctggacctgcagcaccagcgcagacgcaaaaagaagaaggacaaggtcgagatccggaatcggagccccaaggccaatagcacagagtgtcagggcgagcacagcagagagcagaacctgctgaatctggtgcagctgaaccctcacagccctcaccacagaaaggacgaagaggaccaccagaagcggcaccaccaccacaatcaaaagaaaatgagcgtgatggccaagaagtcccagcagcctctcggacaggcctttggctctctgtgtcagctggtgtccgccgatttcagcgcccctcaagtgaccagactgcggagcctgaaccatctgctgatcaacgagggcaacaaccactggcctagagtggaaatgcctaccggttggctgctcgtgggctacaacaccagaaacacagcccagaatcctcggctgcagcagcacctgaaacactggcagcagtgcaccagagccagatggtgccaagagccttgtcagaccctgaccttcttccatttcttcttctttttcaaaacggtgtccctgtgctgccccggctggtctaaaggacaacctcctccacctggcctgaagccttctagcctggcttctcaggtggccagaaccacaggcgtgtaccagcacgtgtggctgatctgcttcgtgttcttcgtgtgcgtggaaaccggcttctgtcacgtggcccaagtgggactcgagagactggtgtctctgagcggcatcaccgacgtgaaccattgggcccagcctaagccatctcctagcaaaggcaccggcatgaacagacccatcggcctgagagttggcaaaggcgtgtgggccagactgagagcctccgtgtctttctggaccctgctgcctacaacaggcgtgcggacaagaggaagccctctgagactgacactgtggcctccacggaacatcctgaacagcctgcctagcagcatggaaatcgccgtgctgcaagagaaccgcaagaccagaaaggccgccagagagaagcacagaaagaccgacaacctgcacctgtgctactaccacagccagagcaaccggaacaagagccggcagatggaaagcctgggcatgaagctgcagagccctctgtgggattgctccaccacaacaggcacacaccacggctgtctgtgggagatccctagcgttacactgctggcctgcagagtgaacgccgtggaagaactgcacagcaggcggatgtctgtgcggatcgtgaagaactgggtgtcctgctgttacgtgcgcctgtctgctgtgggcctgtctacttggagcgccctggacgtggtcatcaacctgaagcggctgcagaagttcagccagaagtctcagcaccactgcgccctgagaaagatcgagtgggccacaaagctgagcctcggcggaaaagctggaccccaggctcaagagaaggccaacgccaagaagatgcccttccagcggtggatcttcagcaatcagctgaccgtgcagatgctgtgcctgcctattgaagccctgactgccctgttcacctgtcggacagccagcatcagcgtgaacatcagcaccctgatgagcatcctggaagcccctctgttttttcacggcgacctgtgcgaggaaaagaagaacggccggatcagcagccaggctcctctcagactttggtcttggtgcggcacaagccagacctactttggcagcaccgccaagaaaagccccaccagcttttgctgcgagtggggaggacaggctcaccggcagagaaataccggaatggaaatcctgctgtggattctgctcaagatggaaattcagatcttcaagatttgcctgggcgagatgcagctgtgcacctacacaccccacatctgcagacacacctgtagaggcggacctagcgccagcgatagatgctgtagctgtagccctagcggcttcagcgccggaagaggcagatgtccagttcagggatgtctgcggcctcacagagtgcagctgctgagaagatggggccctggatctcctgctggccagagactgtctaagggctttcagctgctccgttggtggggaccaggatctccagctcctgagcctagaaagggcccatttccaccacctgatcctccatggcctgtgaccgctgtgacagtgatggctggctctgtgcctagcgctcagtctgtggatgctctggaaagccctggacctctggcactggaaggacctagcagccccagaaacctgctctggcgggaaatgagcatcttcctgcctggcatcttcacctctcggattctgaacctgcaagtgctgaagaagatcctgcggagctttatgaagctgtaccactctctggtcatgtgcctgcggctgcggaccaagctggaaaaagctctgagcgctctgttcatctggccccagcacagctacaagcagaggcctcctctgcagcctgtgcaggtcgtgctcagactgggaaacctgcctccattcttcagaggcagcgaggtgccctttcctagaccttgccggaccaagatgctgaaccagaagtgtctggcccctttcatcacacacccattcgcctctcagcccctgggacaagagatgcccaacaacacccagatcagactgctgaagcccctgctgacccctgacaccagatggatcttctccaaccagctgcagacagtccagatgctctgtctgccacctctgaagcagggcgagagaatcatttggcccctcggcggctttcagatccccaacttcttttggagcctcggaatcggccacactggcgcctggtggcatactggaaggcggagaagagaatggggcggctccaccgtgtctagaagcccactgtggatcagctccatgatctacctgagaggcatggccttcgccagcgacagctccatcagaaccaccagagtgtcctggtgcagaagatgcggcgccaaatctgccgctgcctccagcctcaagaagaaaccccgggacatctgtcggatcagcgactctaagaagatgacccagaagcgcgagagcaccctgggcaatttctggatgaagctcctccagctgccagacaagaagaagaagtctaccgaaaagaccaagatcatcaagaagatgaagaaacggatcatggtccacatgtgcagctccctggctctgccaacaggcctgacatctctgatcctgccaagcagcgatctggccgtgctgatctctagctccaccagccactttctgatgcggagcccagtgctgcctagctccagactgacttgtgcctctccacagctgcccagaatgtggacctggtccagctggctgaagtggctgaaaaactggaagcggttcaagcttaaaaagaagtacatcctggccatgacgctgaccctgaacgggcatccaagaaccgcctctatcaccctgcctaccaccagcctgaagggctctagaaccagctgttgccccagatctcaccccagactgcctaggacaaagtggcctctgcagtgcctgctgcacagcctgggaacaactggaacactcgtgtgggaaaggggcgtgctgcagatgagaagtctggaagctcactgccctctgcagaccttccacctccaccactgtagaactcagcccagctcttgccctcctgcatggattctgtaccaaggacagtggagcggagccgtcgtgggacttagacctgtggctcaccatctgccaagacctattcagggcctgcactgcccacaggctccacatcaaccagctctgtcttggggcaagtggcccgtgggaatgacaggacctgccagatgttgccggtggcctagacgggaactcaaaaagaatctgctgctcccctgccggtgcagacgcgagtatagagtgacaatgggccaagccttcggcagctttagcgccgactttagcgctccccaggtgttgaagaagaatcggaagcagaacaagattatctgcaagggccaccgcatcacaagcctgatcctgagctttcagcgcgtgaaacttaagaagaaagtcaacgcctgctctcccgcctgcacctctaaagcctggactcccagaaagctcgtggggagagccgtcagaagaaagggcatcatctgtatcaagaatatgttcctgcagcggaagggtttcctgaacctgagccacgtggaaaagttcgtgcctccttctcctcctctggctctcggccctagaatgcagctctgtacccagctggcccggttcttccctatcacacctcctgtgtggcacatcctgggacctcagaggcacaccccttgtcaaaagaaggtgccctccgctagcccatggggccttagaccatctccttgcctgagctggtcctccagaattgtggcccctggacacgccctgagctgtcggactagaagaagatggtccagcaagggctacccctacgatgtccctgactatgcgtcc

SEQ ID NO: 1139 - DNA, 4690 bp, Artificial Sequence
  Cloning cassette hTPA 1A
gaattcggatcccgcgacttcgccgccatggatgcaatgaagagagggctctgctgtgtgctgctgctgtgtggagcagtcttcgtttcgcccagccaggaaatccatgcccgaaccgagatccagctgaccatgaacgacagcaagcacaagctggaaagccccgctctgaaacaggtgtcaccagcctctccacctactcagcagcctcagacacctcaggattctagacaggtgctggccctggccaagaaaaccctgacaaatgcctccagagccggacagtttcctgtgtggcggagaacaagcagaggcatgagcctgcagtggaagtccggcaatgcctgcacacctctgagatgccctagcagaagccctgccacattcctgacagccctgaatggctggcacagatctggcctgagagcccagatgcctagctcttggtctagcagcggcagaacactgaagctggcccctctgcaagtgaccaccactctgaagctgatcctggtcatgctggaaatcgtgaccgagcgctccctgctgtactccagaatgtgtctggtgcagatccccacacacacctgggagcccgattacttcgtgtccctgcctatgatgttcagctgggccacacagtcttttcccgtgggcgccgtgtttctgaccagacctgccattccttgctgcagctgtaccagccacagcaacccttggagccagagcaatcagcagctgaagtggacccctcacatcctgaagtccgccagcttcgacaagaaaggcttcgtgatcctgagccggcggagcaagattgaggcctctcctatcggctctatcgccagctctcctggacatcctctgggacctacactggccatcagattcatcagcgcccctcagcctagcagctctacagtgacagctgcccctagcggccagtactttatcgccaagaagcggatcaagctgcggcggaacaatatgggcggcaacagatccatctgcctgaccagaaagcgcaagagagagaagcggagccagaagtccaggcagaaccatctgcagctgaaaagctgcagacggaagatcagcaactggtccaagctgagaagcccctggatcttcaccaagtgcgagatctgcgtgaagaacaccgccatcctggctatcaccctgatcacccctcaggaccctcatctggaccctgtgtgtcaccctcatagaaggcctggatggaagggccaccatagagtggtgttctctcaccatcctagcggcagcacaaagagccactggcagcaaagagaacgcggaggcggcagacgcgagaagaagggatgtagagaacagcggaaggtggtcaagaacccctctcagcccgtgcctctgagaaacgatggcatcaccaacggcaacgactccaccagaagctgctccatcagcctgaagaaaagcctggaaaagatgcccctgatgcggagagccagacctaccagctgtagcacctgtagaatgtggtggaagggcaagaaacggcggaaagaaatcgtgcctatgagcctggcctgcagcatcaccgtgtcttttgtgggacagatcagcaccctggtgctggatgtgtctagcatcagccattggcggctgccctgtaaagtgaccgagagcagctccagcttcttctacaccagcgacaggacccctctgagcatcagcagaccaaccagcagagctagacagagctgttgtctgcccggactgacacaccctgctcaccaacctctgggcagcatgagcactagaagagagatgccaagccaggccacaccttctccacctggaccttggagagccgctctgggcaaagaagtgaagagatcccagagcaagctgcgcctgagaaacacaagccctggggagaagaacgatctccagctgttcgtgatgagcgacaccacctacaagatctactggacagtgatcctgctgaacccctgcggcaacctgcacctgaaaacaacatcactgcagcggccacctcggagcatcctgtctctgaatggaatctgggaagtgatgccccggacactggaaggctgcatcagcgtgaaggatcacagaaccagccagaaccacagcaagtgcatcaccgaatgtgtgcggactgccctgaacgtgtccaagaagagactgcctaagctgatgaagaagaaggacagcaccatcttcatcaacaaagtgcgccagaacttcaagcgcaacttcaagaagaagaaacccctcactttcagccccagcagacggatgactcggagaaccatgacaaccaccaaaatgatgatgatgcggcggaccaagcggagaaggcgcaaaaggcggagaatgaccatgatgaccagacggaccctgctgacaaagaaaacctgtctgacccctagaaccagcgccgccacaaaagctctgcctagacagaccatcagccagcggaggcctattcagaccccacctggaacatctctggccatctggggcagaacaagactgaccctgacaggcaccagatccagcggaacaagagcctctccttccgccgtgtgcctgtgttgttggacctgtccaagcagaagcttcccagccgcttctcctagtggactgagagcacctgttggagcccaggctcctcctgaagtgacactgagagcctcttgtgcctctagcgcctctaaagcctgtgctggactttggccttggggagcccaagttcgagttggagctggaacaggcggaggacctgcttgtgttcctgtggctgaagcttctacaggcgcatggacagctgaaggcgccgctggaacaagatgtagagcctctagagccccttgccgccaacttcctgctagctcccctaccaagtgtgaaatttgtgtgaagcgcagacggcggagaaagagaagcagccagtctagaagccccgtgcctaaaaagcgcgagaggatgatgctgcctgtgcgggccagaacagctagatctgcacttcctcagggcagagcacctctggaagggatgctgcttcctagagcactgcctagcctgctgagcagaatgcctgccagaagagagtcccggttttggctggctctgcaggcacttggactcagacctccacatctgcctagctgtcatcctctgcctcaactgttgggccctccacctcctcatcaggccccaatgacactgaaggccctggttaagacctggacacagttccgcaactaccccagagccgacaagaagaatgtccggtctaccgccttcttcctgctggacatcatcctgggcgattgcccaagaacaatggccggaccttctgcctctctgcatcctgcatctggcagagcctccagaaagacctggcagagaaggctgagagcttgtagagcaggcggacctgctggatgggctagacaggcctatcctagactgaaaaccttcggcgtgcccctgggctctattctgtgtctggccggcagcctgtccacaatgatgatcattagcaccaccagacaagagtgcggcaggcgggcttctgtgccttgtagacctatgatcggaagcgccagaccaggaccttggcggacatctgctatgcctagtgccatgggagtcgccctgcctacctcttgtgaaagcggaagatctcctcctgccaccggcggaagaatgccaggatctcagtctatcatgatgagctggatgcctccactggctccatgtgccgcttgtccatgttctcccgctcctacactgtgcccagcacatcctgctagagcaccaacagccgtgcctgcctttacacctctgtctgctcatcctgtgccagtgctgtctggatgtcacctggccgtcagaacctccatgctgacactgctgcccatggaagccaaaaagagcatgaagcggtccaacgctaagaaaatggaagatatgatctgggagagccggctgccactgaggccacaaagaggacctagacctctgcacagatggctgcagcagacaaccggctgtagccagaggcggatcgtgttctttctggccccatacttccctcggcaccctcacagatctccaccaacatcttgcccacctctgctggaagctttcccactgccaagagcttctctgagggccacagtgccaagacatagctctgttctcgccaccggtctgcacctccacagacagatttctctgcccctgagaggattcctcctgcaccaaccactgccaggacagcatctgtggctgtctcacagactgaggctgagactgcccaggacacagccatctttgcctggaccatgtgcaagcctgctgtccacactgtctcagccaccacctcaggctccatctcaagtgtggactgccgctacactgagatgtcctgctgttcctgcagctgcctgtcctcctgctctgagatccatgcctaagagccggaaccaggtgctgttcagacggaatctgaccccaagccagctgagaacactggccccaccttatatgctgctgccccagtctctgtcccagagcctgagtagaaagcagatccctagccagtccatgctcgtgggctacccctacgatgtccctgactatgcgtcctaaaggcgcgcctagcggccgc

SEQ ID NO: 1140 - DNA, 4672 bp, Artificial Sequence
  Cloning cassette hTPA 2A
gaattcggatcccgcgacttcgccgccatggatgcaatgaagagagggctctgctgtgtgctgctgctgtgtggagcagtcttcgtttcgcccagccaggaaatccatgcccgaagaaagatgcagagcctgaatcaccccagcagactgaccaatggctctcctccactgcacctgtgccagcctctgagaatgagcagaacccctcctagaagagtgtgcgccgctcctccacatagactgctgggcccttccagatggaaccctcggagaaagacctggaagatgcggaagaagtacgcccagaagcctagccagaagaaccacctgtacggcggcaagaagcgctctaagttcagcagaagccacctggacttcagcccctactggatgaagaaagtgaaggtgctgttcaaggccgaccagagcgagtctagcctgagcagcggaagatgcagcctgatggaacagatccctcacctgaagtctcggcggaagtggcagatcagacacgtgctgaagaacctgtggctgcccatgagaagcctgggagaaccttggagagccggctttcagtggggagagtctccttggcaagtgatggcctctctgaccggcagagccacatttctgctggccctttgggaatgtagcctgcctcaggcaagactgtgcctgatcgtgtctagaaccctgctgctggtgcagagccggaacaagaaaacaaagctgtggttcagcctgatcaacatccaccaccggaagaacccactgctgcctatgagatggtggtgtaccagaggcggcggaaagcggaaaaagaaaatgtgcaaggtgtccggcggctgcaccgcctgtgttgagagatgtccttggaagggcatctgctggaagtggcctgtgacagtggccgccattagaatgtgtgccctgtctcaccctagcttctacatcagcagcaccgtgtgctttctgagcaagcactgcatgaccgcctgcaccagaaagagaatgaagaccggcgccatccaagagaagggcgctattcaagagaaaggggccatgaccaagcggatctgcgtggtcaatttcgaggcctgcagagagatggaaagcctgagcgcccctgagaagatcaccctgtttgaagcccacatggcccggtgcacctccatcaatgtgctgtgtgtgcgggccagcctgattgagaagctgatgaaagaaaagcgcaagatgaagcggaaccaggtggcctctccacagatcatgcagcggctgttcatcaagggctaccagaacaaccacttcaccttccatctgcaaaacttcgccttcttcagctccttcggcaacaacaagtacatcaatatcctgaccatcctgttccacgtgcggaacatcgtgtacggcatccaagtgatgctgtgcgctagccctcagattatgcagagaaccagcgccgaccggttccggatgaagagaagaatgcagaatctggacaacctgggcgtgccatggcctctgttgcctggaatcccatctctgaacgcccagtggatgttcctgagaatcgcatccccgcaaatcatgcagaggatgagcgccgtgaacttcgagacaatccgggccagaaaccggaacatgaagaaaaccatgagccacctgatcgcccatcaggccctgaagatgagcggcctgagactgtttcaccccagactgctgacacggaagaagcccggaaaactgctgctcgcccatatgtacggcttcagcacctacggcacccagaaaggcgagtgcgtttgtctgcagtgtctgagcggcagcagcctgttcattctgaagcagcccctggacctgaagatcagcaagaccttcatgggccacagagagggcagcgagtctgataatctgggcctgctgtatagcttccctccaccttatcctatcagcgagggcctgaccatgaccaccggcagaaacatcaacagcaactccctgatgaccaactgcctgttcagccccatcttcctgtgccaccacgccatcatgcacagaaagatgacaagccctcacttcaggctgttcagcagcaagatcccacatcctcaggtgccatctgtggtggccctgtgcaagttccgggccttcatccacacacctagaagccctggctgcagcgtgtacgccaatatgtgctggcccaagttcttcctgaccttcagccagcagtggtccagcgtgacatctctggaatggacagcccaagagagaggctgcagcagctggctgatgaagcagacatggatgaagtcttggagcctgcgggaccccagctacagatccatcctggaatacgtgtccaccagagtgctgtggatgcctacctctaccgtgctgcaggctcatccacaagttccagctctggctcctcaagcctggtggcctgctagaagaggacctctgacatctgccccatccgctcagcagtccctgaccagagagaagattatcaaccccaccatcagctgcccctttcagagccccaccaagagactgatctaccctcctagcacctgttctctgccctgcagaggcttcctgcctagcagatttccttggggcccacctcctctgaacagcgtgatcgtgcacaagatcgtgctggtgttcctgaagtccctgtccagctacaactgcgagcggagaatcagcggcatccagaagagagccatcgagttcgccgtgctgaaactgctgaatatggacctgcctctcgagaacacacagatccccagaacaagcccactgtggaagatcacaatggtgctgacataccccaactgcgtggtgcatgtgctgatgtttggcgccctgagagccacagctcctgctacagctgcacctcaggctcagacccctcattggagagctgccacaacaagcagcatgagcagcagccctagagccgagcctacatcttctagctcttgggccacctgttggcccagatgctgctccagctcttgttactggtcactgtctagctggcctccagctggcgccgctgaagctacaaataccagaaccagaagccgcgagagccagaggggtagaatgctgacttggagaagctccctgtggttgcagggcaccagatgttttacaggcgtgcggaccagctccagatacaagaaaagaggcgtgatcgcctggcggagacagatcaatagacggaagctgcagagaaagaagcactggaacagcgcctacctgggcagaacactgctggtcacctgtatcctgtatcaccggtggatcgtgacctccatgtgtcagtcccagagatggctgaccagcaccacaagtagatctagcgccctgatgtggaccgagctgagcctggaaccatggattccctacctgcatcagcagaaaacccagcggacactggaatccgccggactgtttccttggctgcacacccagtgccaagagaagaaaagcagaaagctgatgtccagctgcacacacccctgcacaatgctgctgccacagggatgtcatcctgcctggctgagccctatctctgcctgtccaagactgctgccatatccttttcacgtgctggctctggaagtgacctttcctcctggaaccgccatgcctcagatgcagttgcaggctctggctatgtgggagaaaggctgggataagcctggcaccagcctgcagtgctacctgaacagaagaagaaacagccggaagcagagccaggtgcaactggccattcaggtgctgctcgtggacaagcacaagtactttctgttcggccaaaagaaaggccacatgatctttagcctggccaacggcctgtggtttaacctgattttcaactcccggaagaaactgctcgaggacatgaagcaaaatggcttcaccggcaaaggcctgacacaccccgtgcctctgaagcggactctgcagaacaaaagaaacaagaatatcaaacgcgtcaaccagaagaagggcaacatcaagcggaagtccatcctgctgcacctgattgtgctgaatagccccgagagcaacctgatcctgatccagcatggcggcatcttcacctttcggttctgggtcgagaagctgtcctggaacatctgcaagaacctgagcctgtacctggacaagttcgtgcagagactgctgtacgtgtacatcatcgagacaaacgtgttcgtgctgaacctgtttcatgtgcccgtgaaccagatcttcatgatggccttctacctgaagtacaccgagaaggcctgggtcatggaactggaatggctgatccaacagcagtgctatcagggcagctgcggcagagcttgttcttgtggaagaggctgtggcacccctagaggcgattggaagagacatcctcctcggagagccttctggaagcctcctagccagggcatctctagctgtctgatgaccggctgttggctcgagaagaaagctacctggatgcggcggacccgccggaagaagagggaagatcattgcggactgagacaccccagctggccttggacaagatgtctgaggatgaggcctccaagaagcggctacccctacgatgtccctgactatgcgtcctaaaggcgcgcctagcggccgc

SEQ ID NO: 1141 - DNA, 4687 bp, Artificial Sequence
  Cloning cassette hTPA 3A
gaattcggatcccgcgacttcgccgccatggatgcaatgaagagagggctctgctgtgtgctgctgctgtgtggagcagtcttcgtttcgcccagccaggaaatccatgcccgaggagctgctgctgcctcttgtcagtctcctccttctcctcgggaaaccacacctagctccgacgccaccagacggacaagacctattgccgctcagagcaagaaaaccatgacagccgccggactgacccctatgatccggaagatccagaagcggcggagaaccgccaaccggtgtctgagagttagatgtggcggctggctgtgtggctggacacctagaggacagaacaccagaagcaccaacctggaaaagaaccccagcctgaagaagcagagccagcggagaggaaagctgagcagcctgttcttcagccactgcctgtgccggaacagcagaagggccacacctacatctaagggcagcctgcggcggaagtacctgagagtgcctattcctccacacctgagacaccctctgctgctgatggacctggacggaatgctgaccgtgatcggacagggactcgtgggcatgacccctagagatctgggaacagtggctggcgccaccgctcagattcagaggcctattcaggtgcagaccggcggcagacttacacctcctcctctgattctgtggcctcaggccgctcctgttgatcctcctggctctgtgtggattctgccctgcaagaacaagaagcggagaaagctgcggcccaagcggctggactttcaccctagatcttctagcggcgtgtccgtgatcaccatgaagctgtgggagaagcacttcaagggcctgaactggaacctggtcgtctggattctgaacctgaagatgatgaacatcgagatcacccctcagcggagcaaggccagaaagtccggcgtgatgaagtgctgggatctgtgccccagcgagaagaagaggaagctgcctctgcctctgaccttcagcaccctgctgtgggactctagacatagaggcgccagctccagcaccagcagagactccagaagctttttcaccagcgctcaccccagcagaccctgcagaatgagactgtaccagttcctgatccacctgagaaaggtggacacccaccatctgcaggtcgtgaccaagaccgtgacagccacaacagctgacggccagagaatgcggagactgaagtgcaaggcctgccggctgagatgggctagacctgaacctgctgctcaggcccctccaaagagccactttccacctcatcctagcggccctagcagaaccagttctctgcagctgcggagcatccctcacgtgccaaaagccacagccgctcacagcgtgacagtgaagctgcagaagggaaagaacagcccctgctgccaaaagaaactgcgggtgcagaatcagggccatctgctgatgatcctgctgcacaatacctacatggaaatgcactacggccatcaggccccacaggtggccatgctgcctaagctgctgtgcagacagatgctgcccactctgagcacactgcagcaaagacacccacagggcccttgtcctccacctgtgacaccactgagagtccagtctgtcctgctgctgggagtgcctcagacagctgctagacagcctagcagacccaccggcagaacccctaccacaagactgatggcccctgtcggcagcgtgatgagctgttctctgctgacccagccttctccagccagcgcctgtacaatgcctccactgctgcatcctcagtgggccccacattctgctggattgtctcccggcgcttgcagacctgcctgtacctgtatcagcatgaccaccatctccagagccacctggcaggtttccgtgtacagcggcaatctgctgagcttctccagacggggcatgaagagtagcgtgcggctgaaaaacagccggcggaacagacggtacagaaagatctacggcgagctgaagatgtccctgcaggccgtggctcctagatgtcctagatctgccgtggacatcagccccggacctacctctcctagcctggcctcttgtgcctctgtggccattggaaaactggccctgcttggcgcttctgccccttgtggtgctgctggcgctagagaggctggaagatttgccgtgctgggcaccatggtcatgaagcacctgaaccgcaagctgcatctgacccggtcctgcctgatcgatctgaccatgatgatgagccagaagctctggaagaaccagcggaagagaatccctctgccatctcctagacagcatctgctccctcagtaccctctgcaccctcctccaccttgtctgctgctgctccaccacagacaccacctggcctttctggaaatggcctgcagcagccagcacacccactccatcaagatctggatcagctttagccacgagcagagcagcccattcctggccagatcctggaacaccatgcagtggaacaacaagaaaatggccatgacagtgatcgctggcgcccaccactgtcagtacaagctgacctacaccaaagtgtggaagatgaattggaagaaaatgatgatcggctcccagcacctcctgttcagccctctggatagctctccactgcaactgctgcttcaccctcacggcaagagatgcaacccttgctgcagactgacatggatgtccatgctgcagaaacagtgctgctacaacctcgtgatcaagcacccactgatcttcagaatcaacctgcggagacagggcaagaccaaggatggcgttgtgcagagcctgggcttcctgaaccagcagatcatcctgcagaaagagttcttcatctgcctgctcatgtttatcaagcggtggaagcctgccgccaccaagagagagtgggagaaacgcaagcagatcctcggcggaggcggcaagtacaaagagtacttcctgaagcgcatcctgattcggaaggccatgactgtgctggccggcgacaagaaaggcctgggcagattcatgagatgcgtgcagagcgagacaaaggccgttagcctgcagctcccactcggaagaggccctgtgtactacgtgtgcaaccggatgaacgtgtccagcgtgctgaagcccttcctgttcaccgtgcctatcgaggacatgagagagtgcacactgggccgcaacagaatgaatgtgtcctctgtgctgaaaccctgtctgatccctgtgccaatcgacctgcctcggatgctgccaatcagcagcccactgcacagaccccagatgccattctggacctgcacctttcctgccacaacatggggcacctgggagacaccttctacatggggctggcggacctttcggggccctagaagaaaagtgctgatggtgctgtggctgcccgccaaccagagtctgcagaaaagccaagtgttccagtgggtcctgcggaccgagaacatccggaagctgatctggaccaagcagcggagcttcctgtctctgttccccaagctgagagccaccgaacagatgaccaatgtgggctgcgccttcagcggccggattctgcatcaacctgaaatggccgccatgcggctgatgcccaagttcctgaatagcaccaacagctggtggacctgtaccaacctgagcgtgcccatgatgctgaccattctgatttggaagcgggtgttcattctcctgctgtccgacaagaagctgctgaagaagtctagccagctgaggcggtcttggagaaacgtgtcccggatcagccaccagatgaagtgtctgaccgccgtggactgtctgcaggccttctgggacatgaacatggaacaccggctgaccatggacagcgccctgagcctgacaaagagagagggacccgagacttgcaagaagaagctcctgctgaaactgctgacaatgagcctgagcaacatcctgatgaagttccggctgcggctgagaatcccaagcctgaggaagtatcgccagcatctgaaaaagaccagcgccaagggcgagaagctgaagcactgctttaaggcttggggcagaggcccacctctgcacacaagaagccagaagaaagaccctgccggcaagctgaaaaaactgaccacactgagcttcgtgctgatcgaggaacggcggaacctgcagcggaatctgaaagtcctgtggctcaagaaaagcaccaagagccggtatctgttcttcctgaccgtgtgcggcttcttcgagaagaaacggcctgagtggctgtcctccagaaagaagggacacacaaagaatcggaggaaggccaagcggaagccccagatcgtgcacaagaagagaggcctgttcctcaaaaagaaatacctggtgcagggcgccaagaagatcaccttcctgtccaacggcatggaagcttgcggcacacaccccacaccaagactgagcgacagagtgttcctggtcaagatcaccaccaccacaagcagccccagaagaagcccagcactgagagctagaggcggcaccacaattggcgaagtgaccagcctgtgcttcttctacctgctgtacggctacccctacgatgtccctgactatgcgtcctaaaggcgcgcctagcggccgc

SEQ ID NO: 1142 - DNA, 4690 bp, Artificial Sequence
  Cloning cassette hTPA 4A
gaattcggatcccgcgacttcgccgccatggatgcaatgaagagagggctctgctgtgtgctgctgctgtgtggagcagtcttcgtttcgcccagccaggaaatccatgcccgaatccagaagaagaaacagaaatccatggccaagaagtcccagcagcctctggtgctgaagaagaaccggaagcaagagtggggaggacaggcccacagacagagaaacaacgccaagaagatgcccttccaagaggaaaagaagaacggccggatcagcagcagcctgatcctgagcttccagagagtgaaggacagcaagaaaatgacccagaagatgtgcagctctctggccctgcctacaggcctgacatctctgatcctgcctagcagcgatctggccgtgctgatctctagcagcaccagccactttctgatgcggagccctgtgctgccaagctccagactgacatgtgcctctccacagctgccccggatgtggacatggtctagctggctgaagcaccccagaaccgctagcatcacactgcctaccacaagcctgaagggcagcagaaccagctgctgcccaagatctcaccccagactgcctaggaccaagtggcctctgcagtgtctgctgcacagcctgggaacaacaggcacactcgtttgggaaaggggcgtgctgcagatgagaagcctcgaagcccattgtcctctgcagaccttccatctgcaccactgcagaacccagccaagctcttgtcctcctgcctggattctgtaccaaggccagtggagcggagccgtcgttggacttagacccgtggctcaccatctgcctagacctatccagggcctgcactgtcctcaggctcctcatcaacctgctctgagctggggaaagtggcccgtgggaatgacaggacctgccagatgctgtcggtggccccgcagatctcagaagtctcagcatcactgcgccctgcggaagatcgagtgggccacaaaactgtctctcggcggaaaagccggaccacaggctcaagagaaggccagaccttctccttgcctgtcctggtccagcagaattgtggcccctggacacgccctgagctgtcggactcgtagaagatggtcctccaagtgcagaggcggccctagcgccagcgatagatgttgtagctgtagccccagcggcttcagcgccggaagaggcagatgtcctgtgcagggatgtctgaggccacacagagttcagctgctgagaagatggggcccaggatctcctgctggccagagactgtctaagggcttccaactgctgcgttggtggggacctggatctccagctcctgagcctagaaagggcccatttcctccacctgatcctccatggcctgtgaccgctgtgacagtgatggctggctctgtgcctagcgcacagtctgtggatgccctggaatctcctggacctctggctctggaaggccctagcagccctagaaacctgctgtggcgggaaatgagcatctttctgcccggcatcttctgccaaaagaaggtgccatctgccagcccctggggacttgttcctccttctccaccactcgctctgggccctagaatgcagctgtgtacccagctcgccagattcttccccatcacacctccagtgtggcacatcctgggacctcagagacacacacctcaggtggtcctgagactgggcaacctgcctccattcttcagaggcagcgaggtgccctttcctagaccttgccggaccaagaacgagggcaacaatcactggcccagagtggaaatgcctaccggctggctgctcgtgggctacaacaccagaaacacagcccagaatcctcggctgcagcagcatctgaaacactggcagcagtgcacacgggccagatggtgtcaagagccttgtcagaccctgaccttcttccacttcttcttctttttcaaaacggtgtccctgtgttgtcccggctggtccaaaggacaacctccacctcctggcctgaagccttctagcctggcttctcaggtggccagaaccacaggcgtgtaccagcacgtgtggctgatctgcttcgtgttcttcgtgtgcgtggaaaccggcttctgtcacgtggcacaagtgggcctcgagagactggtttctctgagcggcatcaccgacgtgaaccattgggcccagcctaagccatctcctagcaaaggcaccggcatgaacagacccatcggcctgagagttggcaaaggcgtgtgggccagactgctcaagaagaagcctagagacatctgtcggatctccaacagaaagacccggaaggccgccagagagaagcaccgcaaaacagatagagccagcgtgtccttctggactctgctgcctacaacaggcgtgcggacaagaggaagccctctgagactgactctgtggcctcctagatgcagatgcagacgcgagtacagagtgaccatgaacatcctgaacagcctgccaagcagcatggaaatcgccgtgctgcaagaaaccgccaagaaaagccctaccagcttctgctgcaacctggacctgcagcatcagcgcagacgcaaaaagaagaaagacaaggtcgagatccggaatcggagccccaaggccaatagcacagagtgtcagggcgagcacagcagagagcagaatctgctgaatctggtgcagctgaatcctcacagccctcaccaccggaaggacgaagaggaccaccagaagagacaccaccaccacaatcaaaagaagatgagcgtcccactgttcttccacggcgacctgtgtagagagagcaccctgggcaatttctggatgaagctgctccagctgcctcagaggcctccactgcaaccagtgaccggaatggaaatcctgctttggattctgctgaagatggaaattcagatcttcaagatttgcctgggcgagatgcagctctgcacctctcggattctgaacctgcaagtgctgaaaaagatcctgcggagctttatgaagctgtaccacagcctcgtgatgtgcctgcggctgaggaccaagctggaaaaggctctgagcgccctgttcatctggcctcagcactcctacaagatcacacacccattcgccagccagccactgggacaagagatgcccaacaacacccagatccggctgctgaagcccgacaagaagaagaaaagcaccgaaaagaccaaaggccaggctttcggcagcttctccgccgatttttcagcccctcaaggacaggcttttggctccctgtgtcagctggtgtccgccgactttagcgccccacaagtgaccagactgcggagcctgaaccatctgctgatttggctgaagaattggaagcggttcaagctcaaaaagaaatatcaggcccctctgcggctgtggtcttggtgcggaacaagccagacctacttcggcagcatcatctgtatcaagaatatgttcctgcagcggaagggtttcctgaacctgagccacgtggaaaagttcgagcttaagaagaatcttctgctccccgtcgtgatcaacctgaagagactgcagaaattcatgctgaaccagaagtgcctggctccatttcctgcctgcaccagcaaagcctggacacccagaaaactcgtgggcagagccgtgcggagaaagggcattctggccatgacactgaccctgaacggaatcgaggccctgacagccctgtttacctgtagaaccgcctccatcagcgtgaacatcagcaccctgatgagcatcctggaagccatcatcaagaagatgaagaaacggatcatggtgcaccggtggatcttctccaatcagctgaccgtgcagatgctctgcctgcctctgctgacccctgacaccagatggatctttagtaatcagctgcagacagtgcaaatgctgtgtctgccacctctgaagcagggcgagagaatcatttggccactcggcggctttcagatccccaatttcttctggtccctcggcatcggacacactggcgcatggtggcatactggtagaaggcggagagagtggggcggctctaccgtgtctagaagcccactgtggatcagctccatgatctacctgagaggcatggccttcgccagcgacagctccatcagaaccaccagagtgtcctggtgtcggagatgtggcgccaagtctgccgcagcctcttcttctccactgtgggattgcagcaccacaaccggcacacaccacggatgcctgtgggagatccctagcgttaccctgctggctaacctgcacctgtgctactaccactctcagagcaacagaaacaagagccgccagatggaatccctgggcatgaagctccaacttaaaaagaaagtgaacgcctgcagcacctacacaccccacatctgcagacacacctgtcgcgtgaacgccgtcgaggaactgcactctagaaggatgtccgtgcggatcgtgaaaaattgggtgtcctgctgctacgtgcggctgtcagctgtgggactgtctacttggagcgctctggacaacaagatcatctgcaagggccacagaatcaccggctacccctacgatgtccctgactatgcgtcctaaaggcgcgcctagcggccgc

SEQ ID NO: 1143 - DNA, 4690 bp, Artificial Sequence
  Cloning cassette hTPA 1B
gaattcggatcccgcgacttcgccgccatggatgcaatgaagagagggctctgctgtgtgctgctgctgtgtggagcagtcttcgtttcgcccagccaggaaatccatgcccgaaccgagatccaattgaccatgaacgacagcaagcacaagctggaaagccccgctctgaaacaggtgtcaccagcctctccacctactcagcagcctcagacacctcaggatagcagacaggtgctggccatgcctagcagctggtctagctctggcagaacccagcggaaggtggtcaagaatcctagccagcctgtgcctctgagaaacgacggcatcaccaacggcaacgactccaccagaagctgcagcatcagcctgaagaaaagcctggaaaagatgcccctcatgatgaagaagaaggacagcaccatcttcatcgtgcccatgagcctggcctgtagcatcaccgtgtctttcgtgggccagatcagcacactggtgctggatgtgtccagcatctcccactggaacaaagtgcggcagaacttcaagcggaacgccgacaagaagaacgttcggagcggcgagaagaacgacctgcagctgtttgtgatgagcgacaccacctacaagatctactggaccgtgatcctgctgaacccctgcggcaatctgcacctgaaaaccaccagcctgggcgactgtcctagaacaatggccggaccttctgcctctctgcaccctgcatctggcagagcctctagaaagacctggcagagaaggctgagagcctgtagagctggtggacctgctggatgggccagacaggccttcgataagaaaggctttgtgatcctgagcgtcggagccggaacaggcggaggacctgcttgtgttcctgtggctgaagcttctacaggcgcttggacagctgaaggcgccgctggaacaagatgtagagcttctagagccccttgcagacagctgcctgccagctctcctaccaagtgcgagatctgcgtgaagcgcagacggcggagaaagagaagcagccagtctagaagccccgtgcctaagaaacgcgagagaatgatgctgcccgtgcgggccagaacagctagatctgcacttcctcaggggagagcccctcttgagggaatgctgcttcctagagcactgcccagcctgctgtctagaatgccagccagaagagagagccggttttggctggctctgcaggcacttggactcagacctccacatctgcctagctgtcatcctctgcctcaactgcttggccctccacctcctcatcaggcccctacagctttcttcctgctggacatcattctgcggctgccctgcaaagtgaccgagtctagcaatatgggcggcaacagatccatctgcctgaccaacgccaagaaaatggaagatatgatctgggagagcacgcccctgagcatcagcagacctacatctagagccaggcagagctgttgtctgcccggactgacacatcctgctcaccagccactgggatctatgaccctggccatcagattcatcagcgctcctcagcctagctccagcacagtgacagctgctcctagcggccagtacttcaagggcaagaagcggcggaaagagatcttcaagaagaagaaacccctgacattcagccccagcctggccaaaaagaccctgaccaatagcagcttcttctacaccagcgaccgcgaggccaagaaatctatgaagcggagcatgaccctgaaggccctggtcaagacctggacacagttcagaaactaccccagagcctcctctcctggacaccctctgggacctaatggcatctgggaagtgatgcccagaacactggaaggctgcatctccgtgaaggaccacagaacaagccagaaccacagcaagtgcatcaccgagtgtgtgcggacagccctgaacagaagaagcaagatcgaggcctctcctatcggctctatcgccctgagatccatgcctaagagcagaaaccaggtgctgttcagacggaatctgaccccaagccagctgagaactctggcccctccttatatgctgctgccccagtctctgagccagagcctgagcagaaagcagatccctagccagtccatgctggtggcctctagagcaggacagtttcctgtgtggcggagaaccagcagaggaatgagcctgcagtggaagtccggcaatgcctgcacacctctgagatgccctagcagaagccctgccacattcctgacagctctgaacggctggcacagatctggactgagagcccagagaaagcgcaagcgcgagaagagaagccagaagtccaggcagaaccatctgcagctgaagtcctgccggcgcaagatctccaactggtccaagctgagaagcccctggatcttcgtgtccaagaagagactgcccaagctgaccaagtgtgaaatctgtgtcaagaacaccgccatcctggctatcaccctgatcacccctcaggaccctcatctggaccctgtgtgtcaccctcatagaaggcctggatggaagggccaccacagagtggtgttttctcatcaccctagcggcagcaccaagagccactggcagcaaagagaacgcggaggcggcagacgggaaaagaagggctgtagagagagatccctgctgtactccagaatgtgcctggtgcagatccccacacacacctgggagcccgattacttcgtgtctctgcccatgatgttcagctgggccacacagtcattccccgtgggagccgtgtttctgaccagacctgccattccttgctgtagctgcacaagccacagcaacccttggagtcagagcagacacccacacagaagcccacctacctcttgtcctccgctgctggaagcctttccactgcctagagcatccctgagagccaccgtgccaagacatagctctgtgctggcaaccggactgcatctgcacagacagatttctctgcccctgagaggattcctgctgcatcaaccactgccaggccagcatctgtggctgtctcatagactgcggctgagactgccaagaactcagcggcctcctagatccatcctgagccttagactgccactgaggccacagagaggacccagacctctgcatagatggctgcagcagaccacaggctgtagccagagaagataccccagactgaaaaccttcggcgtgccactgggctccattctgtgtctggctggatctctgagcaccatgatgatcattagcaccaccagacaagagtgtggcaggcgggcatctgtgccctgtagacctatgatcggaagcgccagaccaggaccttggagaacatctgctatgcctagcgccatgggcgtcgcactgcctacaagctgtgaatccggaagatctcctcctgccaccggcggaagaatgcctggaagccagagcattatgatgagctggatgcctcctctggctccttgtgccgcttgtccttgttctcccgctcctacactgtgtcccgctcatcctgctagagcacctacagccgtgcctgcctttacacctctgtctgcacatcctgtgcctgtgctgtctggatgtcacctggccgtcagaacctccatgctgacactgctgcctatgctgaagctggccccactgcaagtgaccaccacactgaagctgatcctggtcatgctggaaatcgtgaccgagagcactcggagagagatgccttctcaggccacaccttctccacctggaccttggcgagccgctctgggcaaagaagtgaagagatcccagagcaagctgcgcctgagaaacacaagccccatcgtgttctttctggccccatacttccccagacggatgaccagacggaccatgacaaccaccaaaatgatgatgatgcggcggaccaagcggagaaggcgcaaaaggcggagaatgacaatgatgacaaggcggaccctgctgacaaagaaaacctgtctgacccctagaaccagcgccgctaccaaagctctgccaaggcagacaatctcccagcggaggcctattcagacccctcctggaacatctctggccatctggggcaaccagcagctgaaatggacccctcacatcctgaagtccgccagcagaagggccagacctaccagctgtagcacctgtagaatgtggtggatcgccaaaaagcggatcaagctgcggcggaacagaaccagactgacactgacaggcacaagaagcagcggcaccagagcttctccatccgccgtttgcctgtgttgctggacctgtccttccagaagcttcccagccgcttctccaagcggattgagagcacctgttggagcacaggcccctccagaagttacactgagagctagctgtgcctccagcgcctctaaggcttgtgctggactttggccttggggagcacaagttcggcaaccatctttgcctggaccatgcgcttctctgctgagcacactgtctcagccacctccacaggctccatctcaagtgtggacagccgcaacactgagatgtcctgctgttccagctgctgcctgtcctcctggctacccctacgatgtccctgactatgcgtcctaaaggcgcgcctagcggccgc

SEQ ID NO: 1144 - DNA, 4672 bp, Artificial Sequence
  Cloning cassette hTPA 2B
gaattcggatcccgcgacttcgccgccatggatgcaatgaagagagggctctgctgtgtgctgctgctgtgtggagcagtcttcgtttcgcccagccaggaaatccatgcccgaagaaagatgcagagcctgaatcaccccagcagactgaccaacatgagcagaacacctccaagacgcgtgtgcaaccctcggagaaagacctggaagatgcggaagaagtacgcccagaagcctagccagaagaaccacctgtacaacagccggaagaaactgctcgaggacatgaagcagaatggcttcacaggccacagagagggcagcgagtctgataatctgggcctgctgtactcctttcctcctatccggatgtgcgccctgtctcaccctagcttctacatcagcagcaccgtgtgctttctgagcaagcactgcatgaccgcctgcacacaaaagaaaggccacatgatcttcagccgcgagaagatcatcaaccccaccatcagctgcccctttcagagccccacaaagcggctggaactgagcctggaaccttggattccctacctgcaccagcagaaaacccaaggcggcaagaagagaagcaagttccctggcaccagcctgcagtgctacctgaacagatgcagcctgatggaacagatccctcacctgaagtccgcctctccacagatcatgcagagaaccagcgccgaccggttccggatgaagcggagaatgcagaacctggacaatctgggcgttccatggccactgctgcctggacctctggaaaacacacagatccccagaacaagccctctgtggaagatcacaatggtgctgacataccccaactgcgtggtgcacgtgctgatgttctggctgcctatgagatctctgggcgagccttggagagctggctttcagtggggagagtccccttggcaagtgatggctagcctgacaggcccctatcctatcagcgagggcctgaccatgaccaccggcagaaacatcaacagcaactccctgatgaccaactgcctgttcagccccatcttcctgtgccaccacgccatcatgcaccggaagatgacaagcccacacttcagactgttcagcagcaagatcccacatcctcaggtgccatctgtggtggccctgtgcaagttcagagccacatttctgctcgccctgtgggagtgtagtctgcctcaagccagactgtgcctgatcgtgtctagaaccctgctgctggttcagtctgccgctcctccacatagactgctgggcccttctagatggtccagaagccacctggacttcagcccctactggatgaagaaagtgaagctggccaacggcctgtggttcaacctgatcttcgtgctgttcaaggccgaccagagcgagtctagcctgtctagcggccggaacaagaaaacaaagctgtggttctccctcatcaacatccaccaccgcaagaatcctctgctgcccatgagaatccccagcctgaatgcccagtggatgttcctgagaatcctgcttctggcccatatgtacggcttcagcacctacggcacccagaaaggcgagtgcgtttgtctgcagtgtctgagcggcagcagcctgttcattctgaagcagcccctggacctgaagatctccaagaccttcatgctgcaagctcacccacaggtgccagctcttgctcctcaagcttggtggcctgctagaagaggccctctgacatctgctccatccgctcagcagtctctgacagctagccctcagattatgcagcggatgagcgccgtgaacttcgagacaatcatctaccctccaagcacctgtagcctgccttgtagaggcagaacactggaaagcgccggactgtttccttggctgcacacccagtgtacacacccctgtaccatgctgctgccacaaggctggtggtgtacaagaggcggcggaaagcggaaaaagaaaatgtgcaaggtgtccggcggctgcaccgcctgtgttgagagatgtccttggaagggcatctgctggaagtggccagtgacagtggctgctcagtggtctagcgtgacctctctggaatggacagcccaagagagaggctgcagcagctggctgatgaagcaaacatggatgaagtcttggtccctgcgggaccccagctacagatccatcctggaatacgtgtccaccagagtgctgtggatgcccacaagcaccgtgcggagaagaaacagcagaaagcagtctcaggtgcagctggccattcaggtgctgctcgtggacaagcacaagtactttctgttcggcagagcccgcaaccggaacatgaagaaaaccatgagccacctgatcgcccatcaggccctgaagatgagcggcctgaggctgtttcatcctcggctgctgacaagaaagaagcccggcaagttcctgcctagcagatttccttggggccctcctcctctgtgtcatcctgcttggctgagccctatctccgcctgtccaagactgctgccatatccttttcacgtgctggccctggaagtgacctttccacctggaacagccatgcctcagatgcaactgcaggccctggccatgtgggagaaaggctgggataagcggaagagaatgaagaccggcgccatccaagagaagggcgctattcaagagaaaggggccatgaccaagcggatctgcgtggtcaatttcgaggcctgcagagagatggaaagcctgagcgcccctgagaagattaccctgtttgaagcccatatggcccggtgcacctccatcaatgtgctgtgtgtcagagcctctctgatcgagaagctgatgaaagaaaagcgcaagatgaagcgcaaccaggtggcatccccacaaattatgcagaggctgttcattaagggctaccagaacaaccacttcaccttccatctgcaaaacttcgccttcttcagcagcttcggcaacaacaagtacatcaatatcctgacgcggcgcaagaaaagagaggaccactgcggactgctgatcctgatccagcacggcggcatcttcacctttcggttctgggtcgaaaagctgagctggaacatctgcaagaacctgagcctgtacctggataagttcgtgcagcggctgctgtacgtgtacatcatcgagacaaacgtgttcgtgctgaacctgttccacgtgccagtgaaccagatcttcatgatggccttctacctgaagtacaccgagaaggcctgggtcatggaactggaatggctgatccaacagcagtgttaccagcaagagaagaaaagccggaaactgatgagcagctgccgggccttcatccacacacctagaagccctggctgcagcgtgtacgccaatatgtgctgggccttttggaagcctcctagccagggcatcagctcttgtctgatgacaggctgttggggcagccctcctctgcacctgtgtcagcctctgaggcggtataagaaaaggggcgtgatcgcctggcggcggagaaagtggcagatccggcatgtgctgaaaaacctgatcctgtttcatgtgcggaacatcgtgtacggcatccaagtgatgctgtgcggcaagggactgacacaccctgtgcctctgaaacggaccctgcagaacaagaggaacaagaacatcaagcgggtcaaccagaagaagggcaacatcaagaggaagtccatcctgctgcacctcattgtgctgaatagccccgagagcaaccccaagttcttcctgacctttagccagctcgagaagaaagctacctggatgagaagaacaggcgccctgagagccacagctcctgctacagcagctcctcaggctcagactcctcattggagagccgccacaacaagcagcatgagcagcagccctagagccgagcctacatcttctagctcttgggccacctgttggcccagatgctgtagctccagctgttactggtccctgagttcttggcctcctgctggcgccgctgaggctacaaacaccagaactagaagcagagagtcccagcggggcagaatgctgacttggagaagtagtctgtggctgcagggcaccagatgttttacaggcgtgcggacaagcagcggaagctgtggcagagcttgtagctgcggaagaggctgtggaacccctagaggcgattggaagagacaccctcctcggaggaatagcgtgatcgtgcacaagatcgtgctggtgtttctgaagtccctgtccagctacaactgcgagagaaggatcagcggcatccagaagagagccatcgagtttgccgtgctgaaactgctgaatatggacctgcactggaactccgcctacctgggcagaactctgctggtcacctgtatcctgtatcaccggtggatcgtgacctccatgtgccagtctcagagatggctgaccagcaccacaagcagatccagcgctctgatgtggacccggcagatcaatcggaggaagctgcagagaaagaagaggcacccaagctggccttggaccagatgccttagaatgaggcctcctagaagcggctacccctacgatgtccctgactatgcgtcctaaaggcgcgcctagcggccgc

SEQ ID NO: 1145 - DNA, 4687 bp, Artificial Sequence
  Cloning cassette hTPA 3B
gaattcggatcccgcgacttcgccgccatggatgcaatgaagagagggctctgctgtgtgctgctgctgtgtggagcagtcttcgtttcgcccagccaggaaatccatgcccgaggagctgctgctgcctcttgtcagtctcctccttctcctcgggaaaccacacctagctccgacgccaccagacggacaagaccaattgccgctcagagcaagaaaaccatgacagccgccggactgacccctaagaacaagaagcggagaaagctgcggcccaagatgatccggaagatccagaagagaaggcggaccgccaaccggcggaatagcagaagggctacccctacaagcaagggcagcctgagaagaaagtacctgagagtgcggggacctcctctgcacacccggaacatcagaaagctgatctggaccaagcagcggagcttcctgtctctgttccccaagctgagagccaccgagcagatgaccaatgtgggctgctctatccctcacgtgcccaaagccacagccgctcactctgtgacagtgaaactgcagctgcccctgaccttcagcaccctgctgtgggatagcagacacaccatgagcctgagcaacatcctgatgaagttccggctgcagtctagcccattcctggccagatcctggaacaccatgcagtggaacaacaagaaaatggccatgaccgtgatcgctggcgcccaccactgtcagtacaagctgacctacaccaaagtgtggaagatgaactggaagaaaatgatgatcggcagccagcatctgctgttcagccctctggatagcagtcccctgcagctcctgctgcaccctcacggcaagagatgcaacccttgctgcagactgacctggatgagccagaacaccagaagcaccaacctggaaaagaaccccagcctgaagaagcagagccagcggagaggaaagctgagcgcctttagcggcagaatcctgcaccagccagaaatggccgccatgagactgatgcccaagttcctgaactccaccaacagctggtggaccctgaccacactgagcttcgtgctgatcgaggaagccagacagcccagcagacctaccggcagaacacctaccaccagactgatggcccctgtgggcagcgtgatgagctgttctctgctgacccagccttctccagccagcgcctgtacaatgcctccactgctgcatccacagtgggcccctcatagtgctggactttctccaggcgcttgcagacctgcctgcacctgtatcagcatgaccaccatcagcagggccacatggggcccagtgtactacgtgtgcaaccggatgaacgtgtccagcgtgctgaagcccttcctgttcaccgtgcctatcgaggacatgagagagtgcaccctgggcagaaacagaatgaatgtgtcctctgtgctgaaaccctgtctgatccctgtgccaatcagcgagaagaagaggaagctgcccaacatcgagatcacccctcagcggtctaaggccatgctgcagaagcagtgctgctacaacctcgtgatcaagcaccctctgatcttcagaatcaacctgcggcggcagggcaagaccaaagatggcgttgtgcagagcctgggcttcctcaaccagcagatcatcctgcagaaagagttcttcatctgcctgctcatgttcatcaagcggtggaagcctgccgccaccaagagcagaaagaagggccacaccaagaacagacggaaggccaagagaaagccccagatctacctgttcttcctgaccgtgtgcggctttcacctgaaaaagaccagcgccaagtggctgaagaagtccaccaagtccagatccaacggcatggaagcttgcggcacacaccccactcctagactgagctgcctgagagttagatgcggcggctggctgtgtggctggacacctagaggtagaaagtccggcgtgatgaagtgctgggatctgtgccccgtgcacaagaagagaggcctgttcagactggattttcaccccagaagcagctccggcaagggaaagaacagcccctgctgccaaaagaaactgcgggtgcagaaccagggccatctgctgatgattctgctgcacaatgaccgggtgttcctcgtgaagatcggcgagaagctgaagcactgtttcaaggcctggggctccagacggaaccggcggtacagaaagatctacggcgagctgaagatgtccctgcaggccttcctgatccacctgagaaaggtggacacccaccacctccaggtggtcaccaaaacagtgaccgccacaacagccgacggccagagaatgcggagactgaagtgcaaggcctgccggctgagatgggccagacctgaacctgctgctcaggcccctcctaagagccactttccacctcatcctagcggccccagcagaacaagtagcctgcagctgagaagcctgttctttagccactgcctgtgcagccagaagaaggaccctgccggcaagctgaaaaagctgctgaagaaaagcagccagctgcggagaagctggcgcaatgtgtccagaatcagcacccctcctccactgatcctgtggcctcaagctgctcctgtgtccgtgatcaccatgaagctgtgggagaagcacttcaagggcctgaattggaacctggtcgtgtggattctgaacctgaagatgatgacctacatggaaatgcactacggccatcaggccccacaggtggcaatgctgcctaagctgctgtgcagacagatgctgcccactctgagcacactgcagcagagacatcctcagggcccttgtcctcctcctgtgacacctctgagagtccagtctgtcctgctgctgggagtgcctcagacagccagaggacctagaagaaaggtcctgatggtgctgtggctgcccgccaatcagtctctgcagaaaagccaggttttccagtgggtgctgcggacagaggtggcccctagatgtcctagatctgccgtggacatcagccccggacctacatctcctagcctggcctcttgtgcctctgtggccattggaaagctggcactgcttggcgcctctgctccttgtggtgctgctggcgctagagaggccggaagatttgctgtgctgggcaccatggtcatgaagctttgtttcttctacctgctgtaccggctgcgcatcccaagcctgaggaagtacagacagcacctgaaccggaagctgcacctgacaagatcctgcctgatcgatctgaccatgatgatgtcccagaagctctggaagaaccagcggaagagaatccctctgccatctccacggcaacatctgctgccacagtaccctctgcacccacctccaccttgtctgctgttgctgcaccatagacaccacctggcctttctcgagatggcctgtagctctcagcacacccacagcatcaagatctggatcagcttcagccatgaagtggaccctccaggcagcgtgtggatactgccttgcgatctgcctcggatgctgccaatctcttcacccctgcacagaccccagatgcctttctggacctgcacctttcctgccacaacctggggcacatgggagacaccttctacatggggctggcggactttcagaggcgctagcagcagcacatcccgggacagcagatccttcttcacctctgctcaccctagcaggccctgcagaatgagactgtaccagtgcaagaagaagctcctcctgaaactgctgaccaccaccacaagcagccccagaagatcccctgctctgagagcaagaggcggcaccacaatcggcgaagtgaccagctgtaccaacctgagcgtgcccatgatgctgaccatcctgatttggaagcgggtgttcatcctcctgctgagcgataagaagggcgccaagaagatcaccttcctgcctattcctccacacctgagacaccctctgctgctgttcgagaagaaacggcctgagtggctgagcatggacctggacggaatgctgacagtgatcggccagggactcgtgggcatgacccctagagatctgggaacagtggcaggcgccaccgctcagattcagcgacctatccaggtgcagactggcggcagactcagaagaaacctgcagagaaacctgaaggtgctccaggtgtccgtgtacagcggcaacctgctgtcctttagcagacggggcatgaagtctagcgtgcggctgaaaaaccgcgagtgggagaaacggaagcagattctcggaggcggcggaaagtacaaagagtacttcctgaagcgcatcctcatccggaaggctatgacagtgctggccggcgacaagaaaggactgggcagattcatgagatgcgtgcagagcgagacaaaggccgtgtctctgcaactgcctctgggaagaaacatggaacaccggttgaccatggacagcgccctgagcctgacaaagagagagggacccgagacactcaaaaagaaatacctggtccagcaccagatgaagtgtctgaccgccgtggattgtctgcaggctttttgggacatgggctacccctacgatgtccctgactatgcgtcctaaaggcgcgcctagcggccgc

SEQ ID NO: 1146 - DNA, 4690 bp, Artificial Sequence
  Cloning cassette hTPA 4B
gaattcggatcccgcgacttcgccgccatggatgcaatgaagagagggctctgctgtgtgctgctgctgtgtggagcagtcttcgtttcgcccagccaggaaatccatgcccgaatccagaagaagaagcagaagtccaacctggacctgcagcaccagcgcagacgcaaaaagaagaaggacaaggtcgagatccggaatcggagccccaaggccaatagcacagagtgtcagggcgagcacagcagagagcagaacctgctgaatctggtgcagctgaaccctcacagccctcaccacagaaaggacgaagaggaccaccagaagcggcaccaccaccacaatcaaaagaaaatgagcgtgatggccaagaagtcccagcagcctctcggacaggcctttggctctctgtgtcagctggtgtccgccgatttcagcgcccctcaagtgaccagactgcggagcctgaaccatctgctgatcaacgagggcaacaaccactggcctagagtggaaatgcctaccggttggctgctcgtgggctacaacaccagaaacacagcccagaatcctcggctgcagcagcacctgaaacactggcagcagtgcaccagagccagatggtgccaagagccttgtcagaccctgaccttcttccatttcttcttctttttcaaaacggtgtccctgtgctgccccggctggtctaaaggacaacctcctccacctggcctgaagccttctagcctggcttctcaggtggccagaaccacaggcgtgtaccagcacgtgtggctgatctgcttcgtgttcttcgtgtgcgtggaaaccggcttctgtcacgtggcccaagtgggactcgagagactggtgtctctgagcggcatcaccgacgtgaaccattgggcccagcctaagccatctcctagcaaaggcaccggcatgaacagacccatcggcctgagagttggcaaaggcgtgtgggccagactgagagcctccgtgtctttctggaccctgctgcctacaacaggcgtgcggacaagaggaagccctctgagactgacactgtggcctccacggaacatcctgaacagcctgcctagcagcatggaaatcgccgtgctgcaagagaaccgcaagaccagaaaggccgccagagagaagcacagaaagaccgacaacctgcacctgtgctactaccacagccagagcaaccggaacaagagccggcagatggaaagcctgggcatgaagctgcagagccctctgtgggattgctccaccacaacaggcacacaccacggctgtctgtgggagatccctagcgttacactgctggcctgcagagtgaacgccgtggaagaactgcacagcaggcggatgtctgtgcggatcgtgaagaactgggtgtcctgctgttacgtgcgcctgtctgctgtgggcctgtctacttggagcgccctggacgtggtcatcaacctgaagcggctgcagaagttcagccagaagtctcagcaccactgcgccctgagaaagatcgagtgggccacaaagctgagcctcggcggaaaagctggaccccaggctcaagagaaggccaacgccaagaagatgcccttccagcggtggatcttcagcaatcagctgaccgtgcagatgctgtgcctgcctattgaagccctgactgccctgttcacctgtcggacagccagcatcagcgtgaacatcagcaccctgatgagcatcctggaagcccctctgttttttcacggcgacctgtgcgaggaaaagaagaacggccggatcagcagccaggctcctctcagactttggtcttggtgcggcacaagccagacctactttggcagcaccgccaagaaaagccccaccagcttttgctgcgagtggggaggacaggctcaccggcagagaaataccggaatggaaatcctgctgtggattctgctcaagatggaaattcagatcttcaagatttgcctgggcgagatgcagctgtgcacctacacaccccacatctgcagacacacctgtagaggcggacctagcgccagcgatagatgctgtagctgtagccctagcggcttcagcgccggaagaggcagatgtccagttcagggatgtctgcggcctcacagagtgcagctgctgagaagatggggccctggatctcctgctggccagagactgtctaagggctttcagctgctccgttggtggggaccaggatctccagctcctgagcctagaaagggcccatttccaccacctgatcctccatggcctgtgaccgctgtgacagtgatggctggctctgtgcctagcgctcagtctgtggatgctctggaaagccctggacctctggcactggaaggacctagcagccccagaaacctgctctggcgggaaatgagcatcttcctgcctggcatcttcacctctcggattctgaacctgcaagtgctgaagaagatcctgcggagctttatgaagctgtaccactctctggtcatgtgcctgcggctgcggaccaagctggaaaaagctctgagcgctctgttcatctggccccagcacagctacaagcagaggcctcctctgcagcctgtgcaggtcgtgctcagactgggaaacctgcctccattcttcagaggcagcgaggtgccctttcctagaccttgccggaccaagatgctgaaccagaagtgtctggcccctttcatcacacacccattcgcctctcagcccctgggacaagagatgcccaacaacacccagatcagactgctgaagcccctgctgacccctgacaccagatggatcttctccaaccagctgcagacagtccagatgctctgtctgccacctctgaagcagggcgagagaatcatttggcccctcggcggctttcagatccccaacttcttttggagcctcggaatcggccacactggcgcctggtggcatactggaaggcggagaagagaatggggcggctccaccgtgtctagaagcccactgtggatcagctccatgatctacctgagaggcatggccttcgccagcgacagctccatcagaaccaccagagtgtcctggtgcagaagatgcggcgccaaatctgccgctgcctccagcctcaagaagaaaccccgggacatctgtcggatcagcgactctaagaagatgacccagaagcgcgagagcaccctgggcaatttctggatgaagctcctccagctgccagacaagaagaagaagtctaccgaaaagaccaagatcatcaagaagatgaagaaacggatcatggtccacatgtgcagctccctggctctgccaacaggcctgacatctctgatcctgccaagcagcgatctggccgtgctgatctctagctccaccagccactttctgatgcggagcccagtgctgcctagctccagactgacttgtgcctctccacagctgcccagaatgtggacctggtccagctggctgaagtggctgaaaaactggaagcggttcaagcttaaaaagaagtacatcctggccatgacgctgaccctgaacgggcatccaagaaccgcctctatcaccctgcctaccaccagcctgaagggctctagaaccagctgttgccccagatctcaccccagactgcctaggacaaagtggcctctgcagtgcctgctgcacagcctgggaacaactggaacactcgtgtgggaaaggggcgtgctgcagatgagaagtctggaagctcactgccctctgcagaccttccacctccaccactgtagaactcagcccagctcttgccctcctgcatggattctgtaccaaggacagtggagcggagccgtcgtgggacttagacctgtggctcaccatctgccaagacctattcagggcctgcactgcccacaggctccacatcaaccagctctgtcttggggcaagtggcccgtgggaatgacaggacctgccagatgttgccggtggcctagacgggaactcaaaaagaatctgctgctcccctgccggtgcagacgcgagtatagagtgacaatgggccaagccttcggcagctttagcgccgactttagcgctccccaggtgttgaagaagaatcggaagcagaacaagattatctgcaagggccaccgcatcacaagcctgatcctgagctttcagcgcgtgaaacttaagaagaaagtcaacgcctgctctcccgcctgcacctctaaagcctggactcccagaaagctcgtggggagagccgtcagaagaaagggcatcatctgtatcaagaatatgttcctgcagcggaagggtttcctgaacctgagccacgtggaaaagttcgtgcctccttctcctcctctggctctcggccctagaatgcagctctgtacccagctggcccggttcttccctatcacacctcctgtgtggcacatcctgggacctcagaggcacaccccttgtcaaaagaaggtgccctccgctagcccatggggccttagaccatctccttgcctgagctggtcctccagaattgtggcccctggacacgccctgagctgtcggactagaagaagatggtccagcaagggctacccctacgatgtccctgactatgcgtcctaaaggcgcgcctagcggccgc

SEQ ID NO: 1147 - DNA, 5299 bp, Artificial Sequence
  Cloning cassette hINV 1A
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgaccgagatccagctgaccatgaacgacagcaagcacaagctggaaagccccgctctgaaacaggtgtcaccagcctctccacctactcagcagcctcagacacctcaggattctagacaggtgctggccctggccaagaaaaccctgacaaatgcctccagagccggacagtttcctgtgtggcggagaacaagcagaggcatgagcctgcagtggaagtccggcaatgcctgcacacctctgagatgccctagcagaagccctgccacattcctgacagccctgaatggctggcacagatctggcctgagagcccagatgcctagctcttggtctagcagcggcagaacactgaagctggcccctctgcaagtgaccaccactctgaagctgatcctggtcatgctggaaatcgtgaccgagcgctccctgctgtactccagaatgtgtctggtgcagatccccacacacacctgggagcccgattacttcgtgtccctgcctatgatgttcagctgggccacacagtcttttcccgtgggcgccgtgtttctgaccagacctgccattccttgctgcagctgtaccagccacagcaacccttggagccagagcaatcagcagctgaagtggacccctcacatcctgaagtccgccagcttcgacaagaaaggcttcgtgatcctgagccggcggagcaagattgaggcctctcctatcggctctatcgccagctctcctggacatcctctgggacctacactggccatcagattcatcagcgcccctcagcctagcagctctacagtgacagctgcccctagcggccagtactttatcgccaagaagcggatcaagctgcggcggaacaatatgggcggcaacagatccatctgcctgaccagaaagcgcaagagagagaagcggagccagaagtccaggcagaaccatctgcagctgaaaagctgcagacggaagatcagcaactggtccaagctgagaagcccctggatcttcaccaagtgcgagatctgcgtgaagaacaccgccatcctggctatcaccctgatcacccctcaggaccctcatctggaccctgtgtgtcaccctcatagaaggcctggatggaagggccaccatagagtggtgttctctcaccatcctagcggcagcacaaagagccactggcagcaaagagaacgcggaggcggcagacgcgagaagaagggatgtagagaacagcggaaggtggtcaagaacccctctcagcccgtgcctctgagaaacgatggcatcaccaacggcaacgactccaccagaagctgctccatcagcctgaagaaaagcctggaaaagatgcccctgatgcggagagccagacctaccagctgtagcacctgtagaatgtggtggaagggcaagaaacggcggaaagaaatcgtgcctatgagcctggcctgcagcatcaccgtgtcttttgtgggacagatcagcaccctggtgctggatgtgtctagcatcagccattggcggctgccctgtaaagtgaccgagagcagctccagcttcttctacaccagcgacaggacccctctgagcatcagcagaccaaccagcagagctagacagagctgttgtctgcccggactgacacaccctgctcaccaacctctgggcagcatgagcactagaagagagatgccaagccaggccacaccttctccacctggaccttggagagccgctctgggcaaagaagtgaagagatcccagagcaagctgcgcctgagaaacacaagccctggggagaagaacgatctccagctgttcgtgatgagcgacaccacctacaagatctactggacagtgatcctgctgaacccctgcggcaacctgcacctgaaaacaacatcactgcagcggccacctcggagcatcctgtctctgaatggaatctgggaagtgatgccccggacactggaaggctgcatcagcgtgaaggatcacagaaccagccagaaccacagcaagtgcatcaccgaatgtgtgcggactgccctgaacgtgtccaagaagagactgcctaagctgatgaagaagaaggacagcaccatcttcatcaacaaagtgcgccagaacttcaagcgcaacttcaagaagaagaaacccctcactttcagccccagcagacggatgactcggagaaccatgacaaccaccaaaatgatgatgatgcggcggaccaagcggagaaggcgcaaaaggcggagaatgaccatgatgaccagacggaccctgctgacaaagaaaacctgtctgacccctagaaccagcgccgccacaaaagctctgcctagacagaccatcagccagcggaggcctattcagaccccacctggaacatctctggccatctggggcagaacaagactgaccctgacaggcaccagatccagcggaacaagagcctctccttccgccgtgtgcctgtgttgttggacctgtccaagcagaagcttcccagccgcttctcctagtggactgagagcacctgttggagcccaggctcctcctgaagtgacactgagagcctcttgtgcctctagcgcctctaaagcctgtgctggactttggccttggggagcccaagttcgagttggagctggaacaggcggaggacctgcttgtgttcctgtggctgaagcttctacaggcgcatggacagctgaaggcgccgctggaacaagatgtagagcctctagagccccttgccgccaacttcctgctagctcccctaccaagtgtgaaatttgtgtgaagcgcagacggcggagaaagagaagcagccagtctagaagccccgtgcctaaaaagcgcgagaggatgatgctgcctgtgcgggccagaacagctagatctgcacttcctcagggcagagcacctctggaagggatgctgcttcctagagcactgcctagcctgctgagcagaatgcctgccagaagagagtcccggttttggctggctctgcaggcacttggactcagacctccacatctgcctagctgtcatcctctgcctcaactgttgggccctccacctcctcatcaggccccaatgacactgaaggccctggttaagacctggacacagttccgcaactaccccagagccgacaagaagaatgtccggtctaccgccttcttcctgctggacatcatcctgggcgattgcccaagaacaatggccggaccttctgcctctctgcatcctgcatctggcagagcctccagaaagacctggcagagaaggctgagagcttgtagagcaggcggacctgctggatgggctagacaggcctatcctagactgaaaaccttcggcgtgcccctgggctctattctgtgtctggccggcagcctgtccacaatgatgatcattagcaccaccagacaagagtgcggcaggcgggcttctgtgccttgtagacctatgatcggaagcgccagaccaggaccttggcggacatctgctatgcctagtgccatgggagtcgccctgcctacctcttgtgaaagcggaagatctcctcctgccaccggcggaagaatgccaggatctcagtctatcatgatgagctggatgcctccactggctccatgtgccgcttgtccatgttctcccgctcctacactgtgcccagcacatcctgctagagcaccaacagccgtgcctgcctttacacctctgtctgctcatcctgtgccagtgctgtctggatgtcacctggccgtcagaacctccatgctgacactgctgcccatggaagccaaaaagagcatgaagcggtccaacgctaagaaaatggaagatatgatctgggagagccggctgccactgaggccacaaagaggacctagacctctgcacagatggctgcagcagacaaccggctgtagccagaggcggatcgtgttctttctggccccatacttccctcggcaccctcacagatctccaccaacatcttgcccacctctgctggaagctttcccactgccaagagcttctctgagggccacagtgccaagacatagctctgttctcgccaccggtctgcacctccacagacagatttctctgcccctgagaggattcctcctgcaccaaccactgccaggacagcatctgtggctgtctcacagactgaggctgagactgcccaggacacagccatctttgcctggaccatgtgcaagcctgctgtccacactgtctcagccaccacctcaggctccatctcaagtgtggactgccgctacactgagatgtcctgctgttcctgcagctgcctgtcctcctgctctgagatccatgcctaagagccggaaccaggtgctgttcagacggaatctgaccccaagccagctgagaacactggccccaccttatatgctgctgccccagtctctgtcccagagcctgagtagaaagcagatccctagccagtccatgctcgtgggctacccctacgatgtccctgactatgcgtcctaaaggcgcgcctagcggccgc

SEQ ID NO: 1148 - DNA, 5281 bp, Artificial Sequence
  Cloning cassette hINV 2A
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgagaaagatgcagagcctgaatcaccccagcagactgaccaatggctctcctccactgcacctgtgccagcctctgagaatgagcagaacccctcctagaagagtgtgcgccgctcctccacatagactgctgggcccttccagatggaaccctcggagaaagacctggaagatgcggaagaagtacgcccagaagcctagccagaagaaccacctgtacggcggcaagaagcgctctaagttcagcagaagccacctggacttcagcccctactggatgaagaaagtgaaggtgctgttcaaggccgaccagagcgagtctagcctgagcagcggaagatgcagcctgatggaacagatccctcacctgaagtctcggcggaagtggcagatcagacacgtgctgaagaacctgtggctgcccatgagaagcctgggagaaccttggagagccggctttcagtggggagagtctccttggcaagtgatggcctctctgaccggcagagccacatttctgctggccctttgggaatgtagcctgcctcaggcaagactgtgcctgatcgtgtctagaaccctgctgctggtgcagagccggaacaagaaaacaaagctgtggttcagcctgatcaacatccaccaccggaagaacccactgctgcctatgagatggtggtgtaccagaggcggcggaaagcggaaaaagaaaatgtgcaaggtgtccggcggctgcaccgcctgtgttgagagatgtccttggaagggcatctgctggaagtggcctgtgacagtggccgccattagaatgtgtgccctgtctcaccctagcttctacatcagcagcaccgtgtgctttctgagcaagcactgcatgaccgcctgcaccagaaagagaatgaagaccggcgccatccaagagaagggcgctattcaagagaaaggggccatgaccaagcggatctgcgtggtcaatttcgaggcctgcagagagatggaaagcctgagcgcccctgagaagatcaccctgtttgaagcccacatggcccggtgcacctccatcaatgtgctgtgtgtgcgggccagcctgattgagaagctgatgaaagaaaagcgcaagatgaagcggaaccaggtggcctctccacagatcatgcagcggctgttcatcaagggctaccagaacaaccacttcaccttccatctgcaaaacttcgccttcttcagctccttcggcaacaacaagtacatcaatatcctgaccatcctgttccacgtgcggaacatcgtgtacggcatccaagtgatgctgtgcgctagccctcagattatgcagagaaccagcgccgaccggttccggatgaagagaagaatgcagaatctggacaacctgggcgtgccatggcctctgttgcctggaatcccatctctgaacgcccagtggatgttcctgagaatcgcatccccgcaaatcatgcagaggatgagcgccgtgaacttcgagacaatccgggccagaaaccggaacatgaagaaaaccatgagccacctgatcgcccatcaggccctgaagatgagcggcctgagactgtttcaccccagactgctgacacggaagaagcccggaaaactgctgctcgcccatatgtacggcttcagcacctacggcacccagaaaggcgagtgcgtttgtctgcagtgtctgagcggcagcagcctgttcattctgaagcagcccctggacctgaagatcagcaagaccttcatgggccacagagagggcagcgagtctgataatctgggcctgctgtatagcttccctccaccttatcctatcagcgagggcctgaccatgaccaccggcagaaacatcaacagcaactccctgatgaccaactgcctgttcagccccatcttcctgtgccaccacgccatcatgcacagaaagatgacaagccctcacttcaggctgttcagcagcaagatcccacatcctcaggtgccatctgtggtggccctgtgcaagttccgggccttcatccacacacctagaagccctggctgcagcgtgtacgccaatatgtgctggcccaagttcttcctgaccttcagccagcagtggtccagcgtgacatctctggaatggacagcccaagagagaggctgcagcagctggctgatgaagcagacatggatgaagtcttggagcctgcgggaccccagctacagatccatcctggaatacgtgtccaccagagtgctgtggatgcctacctctaccgtgctgcaggctcatccacaagttccagctctggctcctcaagcctggtggcctgctagaagaggacctctgacatctgccccatccgctcagcagtccctgaccagagagaagattatcaaccccaccatcagctgcccctttcagagccccaccaagagactgatctaccctcctagcacctgttctctgccctgcagaggcttcctgcctagcagatttccttggggcccacctcctctgaacagcgtgatcgtgcacaagatcgtgctggtgttcctgaagtccctgtccagctacaactgcgagcggagaatcagcggcatccagaagagagccatcgagttcgccgtgctgaaactgctgaatatggacctgcctctcgagaacacacagatccccagaacaagcccactgtggaagatcacaatggtgctgacataccccaactgcgtggtgcatgtgctgatgtttggcgccctgagagccacagctcctgctacagctgcacctcaggctcagacccctcattggagagctgccacaacaagcagcatgagcagcagccctagagccgagcctacatcttctagctcttgggccacctgttggcccagatgctgctccagctcttgttactggtcactgtctagctggcctccagctggcgccgctgaagctacaaataccagaaccagaagccgcgagagccagaggggtagaatgctgacttggagaagctccctgtggttgcagggcaccagatgttttacaggcgtgcggaccagctccagatacaagaaaagaggcgtgatcgcctggcggagacagatcaatagacggaagctgcagagaaagaagcactggaacagcgcctacctgggcagaacactgctggtcacctgtatcctgtatcaccggtggatcgtgacctccatgtgtcagtcccagagatggctgaccagcaccacaagtagatctagcgccctgatgtggaccgagctgagcctggaaccatggattccctacctgcatcagcagaaaacccagcggacactggaatccgccggactgtttccttggctgcacacccagtgccaagagaagaaaagcagaaagctgatgtccagctgcacacacccctgcacaatgctgctgccacagggatgtcatcctgcctggctgagccctatctctgcctgtccaagactgctgccatatccttttcacgtgctggctctggaagtgacctttcctcctggaaccgccatgcctcagatgcagttgcaggctctggctatgtgggagaaaggctgggataagcctggcaccagcctgcagtgctacctgaacagaagaagaaacagccggaagcagagccaggtgcaactggccattcaggtgctgctcgtggacaagcacaagtactttctgttcggccaaaagaaaggccacatgatctttagcctggccaacggcctgtggtttaacctgattttcaactcccggaagaaactgctcgaggacatgaagcaaaatggcttcaccggcaaaggcctgacacaccccgtgcctctgaagcggactctgcagaacaaaagaaacaagaatatcaaacgcgtcaaccagaagaagggcaacatcaagcggaagtccatcctgctgcacctgattgtgctgaatagccccgagagcaacctgatcctgatccagcatggcggcatcttcacctttcggttctgggtcgagaagctgtcctggaacatctgcaagaacctgagcctgtacctggacaagttcgtgcagagactgctgtacgtgtacatcatcgagacaaacgtgttcgtgctgaacctgtttcatgtgcccgtgaaccagatcttcatgatggccttctacctgaagtacaccgagaaggcctgggtcatggaactggaatggctgatccaacagcagtgctatcagggcagctgcggcagagcttgttcttgtggaagaggctgtggcacccctagaggcgattggaagagacatcctcctcggagagccttctggaagcctcctagccagggcatctctagctgtctgatgaccggctgttggctcgagaagaaagctacctggatgcggcggacccgccggaagaagagggaagatcattgcggactgagacaccccagctggccttggacaagatgtctgaggatgaggcctccaagaagcggctacccctacgatgtccctgactatgcgtcctaaaggcgcgcctagcggccgc

SEQ ID NO: 1149 - DNA, 5296 bp, Artificial Sequence
  Cloning cassette hINV 3A
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgggagctgctgctgcctcttgtcagtctcctccttctcctcgggaaaccacacctagctccgacgccaccagacggacaagacctattgccgctcagagcaagaaaaccatgacagccgccggactgacccctatgatccggaagatccagaagcggcggagaaccgccaaccggtgtctgagagttagatgtggcggctggctgtgtggctggacacctagaggacagaacaccagaagcaccaacctggaaaagaaccccagcctgaagaagcagagccagcggagaggaaagctgagcagcctgttcttcagccactgcctgtgccggaacagcagaagggccacacctacatctaagggcagcctgcggcggaagtacctgagagtgcctattcctccacacctgagacaccctctgctgctgatggacctggacggaatgctgaccgtgatcggacagggactcgtgggcatgacccctagagatctgggaacagtggctggcgccaccgctcagattcagaggcctattcaggtgcagaccggcggcagacttacacctcctcctctgattctgtggcctcaggccgctcctgttgatcctcctggctctgtgtggattctgccctgcaagaacaagaagcggagaaagctgcggcccaagcggctggactttcaccctagatcttctagcggcgtgtccgtgatcaccatgaagctgtgggagaagcacttcaagggcctgaactggaacctggtcgtctggattctgaacctgaagatgatgaacatcgagatcacccctcagcggagcaaggccagaaagtccggcgtgatgaagtgctgggatctgtgccccagcgagaagaagaggaagctgcctctgcctctgaccttcagcaccctgctgtgggactctagacatagaggcgccagctccagcaccagcagagactccagaagctttttcaccagcgctcaccccagcagaccctgcagaatgagactgtaccagttcctgatccacctgagaaaggtggacacccaccatctgcaggtcgtgaccaagaccgtgacagccacaacagctgacggccagagaatgcggagactgaagtgcaaggcctgccggctgagatgggctagacctgaacctgctgctcaggcccctccaaagagccactttccacctcatcctagcggccctagcagaaccagttctctgcagctgcggagcatccctcacgtgccaaaagccacagccgctcacagcgtgacagtgaagctgcagaagggaaagaacagcccctgctgccaaaagaaactgcgggtgcagaatcagggccatctgctgatgatcctgctgcacaatacctacatggaaatgcactacggccatcaggccccacaggtggccatgctgcctaagctgctgtgcagacagatgctgcccactctgagcacactgcagcaaagacacccacagggcccttgtcctccacctgtgacaccactgagagtccagtctgtcctgctgctgggagtgcctcagacagctgctagacagcctagcagacccaccggcagaacccctaccacaagactgatggcccctgtcggcagcgtgatgagctgttctctgctgacccagccttctccagccagcgcctgtacaatgcctccactgctgcatcctcagtgggccccacattctgctggattgtctcccggcgcttgcagacctgcctgtacctgtatcagcatgaccaccatctccagagccacctggcaggtttccgtgtacagcggcaatctgctgagcttctccagacggggcatgaagagtagcgtgcggctgaaaaacagccggcggaacagacggtacagaaagatctacggcgagctgaagatgtccctgcaggccgtggctcctagatgtcctagatctgccgtggacatcagccccggacctacctctcctagcctggcctcttgtgcctctgtggccattggaaaactggccctgcttggcgcttctgccccttgtggtgctgctggcgctagagaggctggaagatttgccgtgctgggcaccatggtcatgaagcacctgaaccgcaagctgcatctgacccggtcctgcctgatcgatctgaccatgatgatgagccagaagctctggaagaaccagcggaagagaatccctctgccatctcctagacagcatctgctccctcagtaccctctgcaccctcctccaccttgtctgctgctgctccaccacagacaccacctggcctttctggaaatggcctgcagcagccagcacacccactccatcaagatctggatcagctttagccacgagcagagcagcccattcctggccagatcctggaacaccatgcagtggaacaacaagaaaatggccatgacagtgatcgctggcgcccaccactgtcagtacaagctgacctacaccaaagtgtggaagatgaattggaagaaaatgatgatcggctcccagcacctcctgttcagccctctggatagctctccactgcaactgctgcttcaccctcacggcaagagatgcaacccttgctgcagactgacatggatgtccatgctgcagaaacagtgctgctacaacctcgtgatcaagcacccactgatcttcagaatcaacctgcggagacagggcaagaccaaggatggcgttgtgcagagcctgggcttcctgaaccagcagatcatcctgcagaaagagttcttcatctgcctgctcatgtttatcaagcggtggaagcctgccgccaccaagagagagtgggagaaacgcaagcagatcctcggcggaggcggcaagtacaaagagtacttcctgaagcgcatcctgattcggaaggccatgactgtgctggccggcgacaagaaaggcctgggcagattcatgagatgcgtgcagagcgagacaaaggccgttagcctgcagctcccactcggaagaggccctgtgtactacgtgtgcaaccggatgaacgtgtccagcgtgctgaagcccttcctgttcaccgtgcctatcgaggacatgagagagtgcacactgggccgcaacagaatgaatgtgtcctctgtgctgaaaccctgtctgatccctgtgccaatcgacctgcctcggatgctgccaatcagcagcccactgcacagaccccagatgccattctggacctgcacctttcctgccacaacatggggcacctgggagacaccttctacatggggctggcggacctttcggggccctagaagaaaagtgctgatggtgctgtggctgcccgccaaccagagtctgcagaaaagccaagtgttccagtgggtcctgcggaccgagaacatccggaagctgatctggaccaagcagcggagcttcctgtctctgttccccaagctgagagccaccgaacagatgaccaatgtgggctgcgccttcagcggccggattctgcatcaacctgaaatggccgccatgcggctgatgcccaagttcctgaatagcaccaacagctggtggacctgtaccaacctgagcgtgcccatgatgctgaccattctgatttggaagcgggtgttcattctcctgctgtccgacaagaagctgctgaagaagtctagccagctgaggcggtcttggagaaacgtgtcccggatcagccaccagatgaagtgtctgaccgccgtggactgtctgcaggccttctgggacatgaacatggaacaccggctgaccatggacagcgccctgagcctgacaaagagagagggacccgagacttgcaagaagaagctcctgctgaaactgctgacaatgagcctgagcaacatcctgatgaagttccggctgcggctgagaatcccaagcctgaggaagtatcgccagcatctgaaaaagaccagcgccaagggcgagaagctgaagcactgctttaaggcttggggcagaggcccacctctgcacacaagaagccagaagaaagaccctgccggcaagctgaaaaaactgaccacactgagcttcgtgctgatcgaggaacggcggaacctgcagcggaatctgaaagtcctgtggctcaagaaaagcaccaagagccggtatctgttcttcctgaccgtgtgcggcttcttcgagaagaaacggcctgagtggctgtcctccagaaagaagggacacacaaagaatcggaggaaggccaagcggaagccccagatcgtgcacaagaagagaggcctgttcctcaaaaagaaatacctggtgcagggcgccaagaagatcaccttcctgtccaacggcatggaagcttgcggcacacaccccacaccaagactgagcgacagagtgttcctggtcaagatcaccaccaccacaagcagccccagaagaagcccagcactgagagctagaggcggcaccacaattggcgaagtgaccagcctgtgcttcttctacctgctgtacggctacccctacgatgtccctgactatgcgtcctaaaggcgcgcctagcggccgc

SEQ ID NO: 1150 - DNA, 5299 bp, Artificial Sequence
  Cloning cassette hINV 4A
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgatccagaagaagaaacagaaatccatggccaagaagtcccagcagcctctggtgctgaagaagaaccggaagcaagagtggggaggacaggcccacagacagagaaacaacgccaagaagatgcccttccaagaggaaaagaagaacggccggatcagcagcagcctgatcctgagcttccagagagtgaaggacagcaagaaaatgacccagaagatgtgcagctctctggccctgcctacaggcctgacatctctgatcctgcctagcagcgatctggccgtgctgatctctagcagcaccagccactttctgatgcggagccctgtgctgccaagctccagactgacatgtgcctctccacagctgccccggatgtggacatggtctagctggctgaagcaccccagaaccgctagcatcacactgcctaccacaagcctgaagggcagcagaaccagctgctgcccaagatctcaccccagactgcctaggaccaagtggcctctgcagtgtctgctgcacagcctgggaacaacaggcacactcgtttgggaaaggggcgtgctgcagatgagaagcctcgaagcccattgtcctctgcagaccttccatctgcaccactgcagaacccagccaagctcttgtcctcctgcctggattctgtaccaaggccagtggagcggagccgtcgttggacttagacccgtggctcaccatctgcctagacctatccagggcctgcactgtcctcaggctcctcatcaacctgctctgagctggggaaagtggcccgtgggaatgacaggacctgccagatgctgtcggtggccccgcagatctcagaagtctcagcatcactgcgccctgcggaagatcgagtgggccacaaaactgtctctcggcggaaaagccggaccacaggctcaagagaaggccagaccttctccttgcctgtcctggtccagcagaattgtggcccctggacacgccctgagctgtcggactcgtagaagatggtcctccaagtgcagaggcggccctagcgccagcgatagatgttgtagctgtagccccagcggcttcagcgccggaagaggcagatgtcctgtgcagggatgtctgaggccacacagagttcagctgctgagaagatggggcccaggatctcctgctggccagagactgtctaagggcttccaactgctgcgttggtggggacctggatctccagctcctgagcctagaaagggcccatttcctccacctgatcctccatggcctgtgaccgctgtgacagtgatggctggctctgtgcctagcgcacagtctgtggatgccctggaatctcctggacctctggctctggaaggccctagcagccctagaaacctgctgtggcgggaaatgagcatctttctgcccggcatcttctgccaaaagaaggtgccatctgccagcccctggggacttgttcctccttctccaccactcgctctgggccctagaatgcagctgtgtacccagctcgccagattcttccccatcacacctccagtgtggcacatcctgggacctcagagacacacacctcaggtggtcctgagactgggcaacctgcctccattcttcagaggcagcgaggtgccctttcctagaccttgccggaccaagaacgagggcaacaatcactggcccagagtggaaatgcctaccggctggctgctcgtgggctacaacaccagaaacacagcccagaatcctcggctgcagcagcatctgaaacactggcagcagtgcacacgggccagatggtgtcaagagccttgtcagaccctgaccttcttccacttcttcttctttttcaaaacggtgtccctgtgttgtcccggctggtccaaaggacaacctccacctcctggcctgaagccttctagcctggcttctcaggtggccagaaccacaggcgtgtaccagcacgtgtggctgatctgcttcgtgttcttcgtgtgcgtggaaaccggcttctgtcacgtggcacaagtgggcctcgagagactggtttctctgagcggcatcaccgacgtgaaccattgggcccagcctaagccatctcctagcaaaggcaccggcatgaacagacccatcggcctgagagttggcaaaggcgtgtgggccagactgctcaagaagaagcctagagacatctgtcggatctccaacagaaagacccggaaggccgccagagagaagcaccgcaaaacagatagagccagcgtgtccttctggactctgctgcctacaacaggcgtgcggacaagaggaagccctctgagactgactctgtggcctcctagatgcagatgcagacgcgagtacagagtgaccatgaacatcctgaacagcctgccaagcagcatggaaatcgccgtgctgcaagaaaccgccaagaaaagccctaccagcttctgctgcaacctggacctgcagcatcagcgcagacgcaaaaagaagaaagacaaggtcgagatccggaatcggagccccaaggccaatagcacagagtgtcagggcgagcacagcagagagcagaatctgctgaatctggtgcagctgaatcctcacagccctcaccaccggaaggacgaagaggaccaccagaagagacaccaccaccacaatcaaaagaagatgagcgtcccactgttcttccacggcgacctgtgtagagagagcaccctgggcaatttctggatgaagctgctccagctgcctcagaggcctccactgcaaccagtgaccggaatggaaatcctgctttggattctgctgaagatggaaattcagatcttcaagatttgcctgggcgagatgcagctctgcacctctcggattctgaacctgcaagtgctgaaaaagatcctgcggagctttatgaagctgtaccacagcctcgtgatgtgcctgcggctgaggaccaagctggaaaaggctctgagcgccctgttcatctggcctcagcactcctacaagatcacacacccattcgccagccagccactgggacaagagatgcccaacaacacccagatccggctgctgaagcccgacaagaagaagaaaagcaccgaaaagaccaaaggccaggctttcggcagcttctccgccgatttttcagcccctcaaggacaggcttttggctccctgtgtcagctggtgtccgccgactttagcgccccacaagtgaccagactgcggagcctgaaccatctgctgatttggctgaagaattggaagcggttcaagctcaaaaagaaatatcaggcccctctgcggctgtggtcttggtgcggaacaagccagacctacttcggcagcatcatctgtatcaagaatatgttcctgcagcggaagggtttcctgaacctgagccacgtggaaaagttcgagcttaagaagaatcttctgctccccgtcgtgatcaacctgaagagactgcagaaattcatgctgaaccagaagtgcctggctccatttcctgcctgcaccagcaaagcctggacacccagaaaactcgtgggcagagccgtgcggagaaagggcattctggccatgacactgaccctgaacggaatcgaggccctgacagccctgtttacctgtagaaccgcctccatcagcgtgaacatcagcaccctgatgagcatcctggaagccatcatcaagaagatgaagaaacggatcatggtgcaccggtggatcttctccaatcagctgaccgtgcagatgctctgcctgcctctgctgacccctgacaccagatggatctttagtaatcagctgcagacagtgcaaatgctgtgtctgccacctctgaagcagggcgagagaatcatttggccactcggcggctttcagatccccaatttcttctggtccctcggcatcggacacactggcgcatggtggcatactggtagaaggcggagagagtggggcggctctaccgtgtctagaagcccactgtggatcagctccatgatctacctgagaggcatggccttcgccagcgacagctccatcagaaccaccagagtgtcctggtgtcggagatgtggcgccaagtctgccgcagcctcttcttctccactgtgggattgcagcaccacaaccggcacacaccacggatgcctgtgggagatccctagcgttaccctgctggctaacctgcacctgtgctactaccactctcagagcaacagaaacaagagccgccagatggaatccctgggcatgaagctccaacttaaaaagaaagtgaacgcctgcagcacctacacaccccacatctgcagacacacctgtcgcgtgaacgccgtcgaggaactgcactctagaaggatgtccgtgcggatcgtgaaaaattgggtgtcctgctgctacgtgcggctgtcagctgtgggactgtctacttggagcgctctggacaacaagatcatctgcaagggccacagaatcaccggctacccctacgatgtccctgactatgcgtcctaaaggcgcgcctagcggccgc

SEQ ID NO: 1151 - DNA, 5299 bp, Artificial Sequence
  Cloning cassette hINV 1B
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgaccgagatccaattgaccatgaacgacagcaagcacaagctggaaagccccgctctgaaacaggtgtcaccagcctctccacctactcagcagcctcagacacctcaggatagcagacaggtgctggccatgcctagcagctggtctagctctggcagaacccagcggaaggtggtcaagaatcctagccagcctgtgcctctgagaaacgacggcatcaccaacggcaacgactccaccagaagctgcagcatcagcctgaagaaaagcctggaaaagatgcccctcatgatgaagaagaaggacagcaccatcttcatcgtgcccatgagcctggcctgtagcatcaccgtgtctttcgtgggccagatcagcacactggtgctggatgtgtccagcatctcccactggaacaaagtgcggcagaacttcaagcggaacgccgacaagaagaacgttcggagcggcgagaagaacgacctgcagctgtttgtgatgagcgacaccacctacaagatctactggaccgtgatcctgctgaacccctgcggcaatctgcacctgaaaaccaccagcctgggcgactgtcctagaacaatggccggaccttctgcctctctgcaccctgcatctggcagagcctctagaaagacctggcagagaaggctgagagcctgtagagctggtggacctgctggatgggccagacaggccttcgataagaaaggctttgtgatcctgagcgtcggagccggaacaggcggaggacctgcttgtgttcctgtggctgaagcttctacaggcgcttggacagctgaaggcgccgctggaacaagatgtagagcttctagagccccttgcagacagctgcctgccagctctcctaccaagtgcgagatctgcgtgaagcgcagacggcggagaaagagaagcagccagtctagaagccccgtgcctaagaaacgcgagagaatgatgctgcccgtgcgggccagaacagctagatctgcacttcctcaggggagagcccctcttgagggaatgctgcttcctagagcactgcccagcctgctgtctagaatgccagccagaagagagagccggttttggctggctctgcaggcacttggactcagacctccacatctgcctagctgtcatcctctgcctcaactgcttggccctccacctcctcatcaggcccctacagctttcttcctgctggacatcattctgcggctgccctgcaaagtgaccgagtctagcaatatgggcggcaacagatccatctgcctgaccaacgccaagaaaatggaagatatgatctgggagagcacgcccctgagcatcagcagacctacatctagagccaggcagagctgttgtctgcccggactgacacatcctgctcaccagccactgggatctatgaccctggccatcagattcatcagcgctcctcagcctagctccagcacagtgacagctgctcctagcggccagtacttcaagggcaagaagcggcggaaagagatcttcaagaagaagaaacccctgacattcagccccagcctggccaaaaagaccctgaccaatagcagcttcttctacaccagcgaccgcgaggccaagaaatctatgaagcggagcatgaccctgaaggccctggtcaagacctggacacagttcagaaactaccccagagcctcctctcctggacaccctctgggacctaatggcatctgggaagtgatgcccagaacactggaaggctgcatctccgtgaaggaccacagaacaagccagaaccacagcaagtgcatcaccgagtgtgtgcggacagccctgaacagaagaagcaagatcgaggcctctcctatcggctctatcgccctgagatccatgcctaagagcagaaaccaggtgctgttcagacggaatctgaccccaagccagctgagaactctggcccctccttatatgctgctgccccagtctctgagccagagcctgagcagaaagcagatccctagccagtccatgctggtggcctctagagcaggacagtttcctgtgtggcggagaaccagcagaggaatgagcctgcagtggaagtccggcaatgcctgcacacctctgagatgccctagcagaagccctgccacattcctgacagctctgaacggctggcacagatctggactgagagcccagagaaagcgcaagcgcgagaagagaagccagaagtccaggcagaaccatctgcagctgaagtcctgccggcgcaagatctccaactggtccaagctgagaagcccctggatcttcgtgtccaagaagagactgcccaagctgaccaagtgtgaaatctgtgtcaagaacaccgccatcctggctatcaccctgatcacccctcaggaccctcatctggaccctgtgtgtcaccctcatagaaggcctggatggaagggccaccacagagtggtgttttctcatcaccctagcggcagcaccaagagccactggcagcaaagagaacgcggaggcggcagacgggaaaagaagggctgtagagagagatccctgctgtactccagaatgtgcctggtgcagatccccacacacacctgggagcccgattacttcgtgtctctgcccatgatgttcagctgggccacacagtcattccccgtgggagccgtgtttctgaccagacctgccattccttgctgtagctgcacaagccacagcaacccttggagtcagagcagacacccacacagaagcccacctacctcttgtcctccgctgctggaagcctttccactgcctagagcatccctgagagccaccgtgccaagacatagctctgtgctggcaaccggactgcatctgcacagacagatttctctgcccctgagaggattcctgctgcatcaaccactgccaggccagcatctgtggctgtctcatagactgcggctgagactgccaagaactcagcggcctcctagatccatcctgagccttagactgccactgaggccacagagaggacccagacctctgcatagatggctgcagcagaccacaggctgtagccagagaagataccccagactgaaaaccttcggcgtgccactgggctccattctgtgtctggctggatctctgagcaccatgatgatcattagcaccaccagacaagagtgtggcaggcgggcatctgtgccctgtagacctatgatcggaagcgccagaccaggaccttggagaacatctgctatgcctagcgccatgggcgtcgcactgcctacaagctgtgaatccggaagatctcctcctgccaccggcggaagaatgcctggaagccagagcattatgatgagctggatgcctcctctggctccttgtgccgcttgtccttgttctcccgctcctacactgtgtcccgctcatcctgctagagcacctacagccgtgcctgcctttacacctctgtctgcacatcctgtgcctgtgctgtctggatgtcacctggccgtcagaacctccatgctgacactgctgcctatgctgaagctggccccactgcaagtgaccaccacactgaagctgatcctggtcatgctggaaatcgtgaccgagagcactcggagagagatgccttctcaggccacaccttctccacctggaccttggcgagccgctctgggcaaagaagtgaagagatcccagagcaagctgcgcctgagaaacacaagccccatcgtgttctttctggccccatacttccccagacggatgaccagacggaccatgacaaccaccaaaatgatgatgatgcggcggaccaagcggagaaggcgcaaaaggcggagaatgacaatgatgacaaggcggaccctgctgacaaagaaaacctgtctgacccctagaaccagcgccgctaccaaagctctgccaaggcagacaatctcccagcggaggcctattcagacccctcctggaacatctctggccatctggggcaaccagcagctgaaatggacccctcacatcctgaagtccgccagcagaagggccagacctaccagctgtagcacctgtagaatgtggtggatcgccaaaaagcggatcaagctgcggcggaacagaaccagactgacactgacaggcacaagaagcagcggcaccagagcttctccatccgccgtttgcctgtgttgctggacctgtccttccagaagcttcccagccgcttctccaagcggattgagagcacctgttggagcacaggcccctccagaagttacactgagagctagctgtgcctccagcgcctctaaggcttgtgctggactttggccttggggagcacaagttcggcaaccatctttgcctggaccatgcgcttctctgctgagcacactgtctcagccacctccacaggctccatctcaagtgtggacagccgcaacactgagatgtcctgctgttccagctgctgcctgtcctcctggctacccctacgatgtccctgactatgcgtcctaaaggcgcgcctagcggccgc

SEQ ID NO: 1152 - DNA, 5281 bp, Artificial Sequence
  Cloning cassette hINV 2B
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgagaaagatgcagagcctgaatcaccccagcagactgaccaacatgagcagaacacctccaagacgcgtgtgcaaccctcggagaaagacctggaagatgcggaagaagtacgcccagaagcctagccagaagaaccacctgtacaacagccggaagaaactgctcgaggacatgaagcagaatggcttcacaggccacagagagggcagcgagtctgataatctgggcctgctgtactcctttcctcctatccggatgtgcgccctgtctcaccctagcttctacatcagcagcaccgtgtgctttctgagcaagcactgcatgaccgcctgcacacaaaagaaaggccacatgatcttcagccgcgagaagatcatcaaccccaccatcagctgcccctttcagagccccacaaagcggctggaactgagcctggaaccttggattccctacctgcaccagcagaaaacccaaggcggcaagaagagaagcaagttccctggcaccagcctgcagtgctacctgaacagatgcagcctgatggaacagatccctcacctgaagtccgcctctccacagatcatgcagagaaccagcgccgaccggttccggatgaagcggagaatgcagaacctggacaatctgggcgttccatggccactgctgcctggacctctggaaaacacacagatccccagaacaagccctctgtggaagatcacaatggtgctgacataccccaactgcgtggtgcacgtgctgatgttctggctgcctatgagatctctgggcgagccttggagagctggctttcagtggggagagtccccttggcaagtgatggctagcctgacaggcccctatcctatcagcgagggcctgaccatgaccaccggcagaaacatcaacagcaactccctgatgaccaactgcctgttcagccccatcttcctgtgccaccacgccatcatgcaccggaagatgacaagcccacacttcagactgttcagcagcaagatcccacatcctcaggtgccatctgtggtggccctgtgcaagttcagagccacatttctgctcgccctgtgggagtgtagtctgcctcaagccagactgtgcctgatcgtgtctagaaccctgctgctggttcagtctgccgctcctccacatagactgctgggcccttctagatggtccagaagccacctggacttcagcccctactggatgaagaaagtgaagctggccaacggcctgtggttcaacctgatcttcgtgctgttcaaggccgaccagagcgagtctagcctgtctagcggccggaacaagaaaacaaagctgtggttctccctcatcaacatccaccaccgcaagaatcctctgctgcccatgagaatccccagcctgaatgcccagtggatgttcctgagaatcctgcttctggcccatatgtacggcttcagcacctacggcacccagaaaggcgagtgcgtttgtctgcagtgtctgagcggcagcagcctgttcattctgaagcagcccctggacctgaagatctccaagaccttcatgctgcaagctcacccacaggtgccagctcttgctcctcaagcttggtggcctgctagaagaggccctctgacatctgctccatccgctcagcagtctctgacagctagccctcagattatgcagcggatgagcgccgtgaacttcgagacaatcatctaccctccaagcacctgtagcctgccttgtagaggcagaacactggaaagcgccggactgtttccttggctgcacacccagtgtacacacccctgtaccatgctgctgccacaaggctggtggtgtacaagaggcggcggaaagcggaaaaagaaaatgtgcaaggtgtccggcggctgcaccgcctgtgttgagagatgtccttggaagggcatctgctggaagtggccagtgacagtggctgctcagtggtctagcgtgacctctctggaatggacagcccaagagagaggctgcagcagctggctgatgaagcaaacatggatgaagtcttggtccctgcgggaccccagctacagatccatcctggaatacgtgtccaccagagtgctgtggatgcccacaagcaccgtgcggagaagaaacagcagaaagcagtctcaggtgcagctggccattcaggtgctgctcgtggacaagcacaagtactttctgttcggcagagcccgcaaccggaacatgaagaaaaccatgagccacctgatcgcccatcaggccctgaagatgagcggcctgaggctgtttcatcctcggctgctgacaagaaagaagcccggcaagttcctgcctagcagatttccttggggccctcctcctctgtgtcatcctgcttggctgagccctatctccgcctgtccaagactgctgccatatccttttcacgtgctggccctggaagtgacctttccacctggaacagccatgcctcagatgcaactgcaggccctggccatgtgggagaaaggctgggataagcggaagagaatgaagaccggcgccatccaagagaagggcgctattcaagagaaaggggccatgaccaagcggatctgcgtggtcaatttcgaggcctgcagagagatggaaagcctgagcgcccctgagaagattaccctgtttgaagcccatatggcccggtgcacctccatcaatgtgctgtgtgtcagagcctctctgatcgagaagctgatgaaagaaaagcgcaagatgaagcgcaaccaggtggcatccccacaaattatgcagaggctgttcattaagggctaccagaacaaccacttcaccttccatctgcaaaacttcgccttcttcagcagcttcggcaacaacaagtacatcaatatcctgacgcggcgcaagaaaagagaggaccactgcggactgctgatcctgatccagcacggcggcatcttcacctttcggttctgggtcgaaaagctgagctggaacatctgcaagaacctgagcctgtacctggataagttcgtgcagcggctgctgtacgtgtacatcatcgagacaaacgtgttcgtgctgaacctgttccacgtgccagtgaaccagatcttcatgatggccttctacctgaagtacaccgagaaggcctgggtcatggaactggaatggctgatccaacagcagtgttaccagcaagagaagaaaagccggaaactgatgagcagctgccgggccttcatccacacacctagaagccctggctgcagcgtgtacgccaatatgtgctgggccttttggaagcctcctagccagggcatcagctcttgtctgatgacaggctgttggggcagccctcctctgcacctgtgtcagcctctgaggcggtataagaaaaggggcgtgatcgcctggcggcggagaaagtggcagatccggcatgtgctgaaaaacctgatcctgtttcatgtgcggaacatcgtgtacggcatccaagtgatgctgtgcggcaagggactgacacaccctgtgcctctgaaacggaccctgcagaacaagaggaacaagaacatcaagcgggtcaaccagaagaagggcaacatcaagaggaagtccatcctgctgcacctcattgtgctgaatagccccgagagcaaccccaagttcttcctgacctttagccagctcgagaagaaagctacctggatgagaagaacaggcgccctgagagccacagctcctgctacagcagctcctcaggctcagactcctcattggagagccgccacaacaagcagcatgagcagcagccctagagccgagcctacatcttctagctcttgggccacctgttggcccagatgctgtagctccagctgttactggtccctgagttcttggcctcctgctggcgccgctgaggctacaaacaccagaactagaagcagagagtcccagcggggcagaatgctgacttggagaagtagtctgtggctgcagggcaccagatgttttacaggcgtgcggacaagcagcggaagctgtggcagagcttgtagctgcggaagaggctgtggaacccctagaggcgattggaagagacaccctcctcggaggaatagcgtgatcgtgcacaagatcgtgctggtgtttctgaagtccctgtccagctacaactgcgagagaaggatcagcggcatccagaagagagccatcgagtttgccgtgctgaaactgctgaatatggacctgcactggaactccgcctacctgggcagaactctgctggtcacctgtatcctgtatcaccggtggatcgtgacctccatgtgccagtctcagagatggctgaccagcaccacaagcagatccagcgctctgatgtggacccggcagatcaatcggaggaagctgcagagaaagaagaggcacccaagctggccttggaccagatgccttagaatgaggcctcctagaagcggctacccctacgatgtccctgactatgcgtcctaaaggcgcgcctagcggccgc

SEQ ID NO: 1153 - DNA, 5296 bp, Artificial Sequence
  Cloning cassette hINV 3B
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgggagctgctgctgcctcttgtcagtctcctccttctcctcgggaaaccacacctagctccgacgccaccagacggacaagaccaattgccgctcagagcaagaaaaccatgacagccgccggactgacccctaagaacaagaagcggagaaagctgcggcccaagatgatccggaagatccagaagagaaggcggaccgccaaccggcggaatagcagaagggctacccctacaagcaagggcagcctgagaagaaagtacctgagagtgcggggacctcctctgcacacccggaacatcagaaagctgatctggaccaagcagcggagcttcctgtctctgttccccaagctgagagccaccgagcagatgaccaatgtgggctgctctatccctcacgtgcccaaagccacagccgctcactctgtgacagtgaaactgcagctgcccctgaccttcagcaccctgctgtgggatagcagacacaccatgagcctgagcaacatcctgatgaagttccggctgcagtctagcccattcctggccagatcctggaacaccatgcagtggaacaacaagaaaatggccatgaccgtgatcgctggcgcccaccactgtcagtacaagctgacctacaccaaagtgtggaagatgaactggaagaaaatgatgatcggcagccagcatctgctgttcagccctctggatagcagtcccctgcagctcctgctgcaccctcacggcaagagatgcaacccttgctgcagactgacctggatgagccagaacaccagaagcaccaacctggaaaagaaccccagcctgaagaagcagagccagcggagaggaaagctgagcgcctttagcggcagaatcctgcaccagccagaaatggccgccatgagactgatgcccaagttcctgaactccaccaacagctggtggaccctgaccacactgagcttcgtgctgatcgaggaagccagacagcccagcagacctaccggcagaacacctaccaccagactgatggcccctgtgggcagcgtgatgagctgttctctgctgacccagccttctccagccagcgcctgtacaatgcctccactgctgcatccacagtgggcccctcatagtgctggactttctccaggcgcttgcagacctgcctgcacctgtatcagcatgaccaccatcagcagggccacatggggcccagtgtactacgtgtgcaaccggatgaacgtgtccagcgtgctgaagcccttcctgttcaccgtgcctatcgaggacatgagagagtgcaccctgggcagaaacagaatgaatgtgtcctctgtgctgaaaccctgtctgatccctgtgccaatcagcgagaagaagaggaagctgcccaacatcgagatcacccctcagcggtctaaggccatgctgcagaagcagtgctgctacaacctcgtgatcaagcaccctctgatcttcagaatcaacctgcggcggcagggcaagaccaaagatggcgttgtgcagagcctgggcttcctcaaccagcagatcatcctgcagaaagagttcttcatctgcctgctcatgttcatcaagcggtggaagcctgccgccaccaagagcagaaagaagggccacaccaagaacagacggaaggccaagagaaagccccagatctacctgttcttcctgaccgtgtgcggctttcacctgaaaaagaccagcgccaagtggctgaagaagtccaccaagtccagatccaacggcatggaagcttgcggcacacaccccactcctagactgagctgcctgagagttagatgcggcggctggctgtgtggctggacacctagaggtagaaagtccggcgtgatgaagtgctgggatctgtgccccgtgcacaagaagagaggcctgttcagactggattttcaccccagaagcagctccggcaagggaaagaacagcccctgctgccaaaagaaactgcgggtgcagaaccagggccatctgctgatgattctgctgcacaatgaccgggtgttcctcgtgaagatcggcgagaagctgaagcactgtttcaaggcctggggctccagacggaaccggcggtacagaaagatctacggcgagctgaagatgtccctgcaggccttcctgatccacctgagaaaggtggacacccaccacctccaggtggtcaccaaaacagtgaccgccacaacagccgacggccagagaatgcggagactgaagtgcaaggcctgccggctgagatgggccagacctgaacctgctgctcaggcccctcctaagagccactttccacctcatcctagcggccccagcagaacaagtagcctgcagctgagaagcctgttctttagccactgcctgtgcagccagaagaaggaccctgccggcaagctgaaaaagctgctgaagaaaagcagccagctgcggagaagctggcgcaatgtgtccagaatcagcacccctcctccactgatcctgtggcctcaagctgctcctgtgtccgtgatcaccatgaagctgtgggagaagcacttcaagggcctgaattggaacctggtcgtgtggattctgaacctgaagatgatgacctacatggaaatgcactacggccatcaggccccacaggtggcaatgctgcctaagctgctgtgcagacagatgctgcccactctgagcacactgcagcagagacatcctcagggcccttgtcctcctcctgtgacacctctgagagtccagtctgtcctgctgctgggagtgcctcagacagccagaggacctagaagaaaggtcctgatggtgctgtggctgcccgccaatcagtctctgcagaaaagccaggttttccagtgggtgctgcggacagaggtggcccctagatgtcctagatctgccgtggacatcagccccggacctacatctcctagcctggcctcttgtgcctctgtggccattggaaagctggcactgcttggcgcctctgctccttgtggtgctgctggcgctagagaggccggaagatttgctgtgctgggcaccatggtcatgaagctttgtttcttctacctgctgtaccggctgcgcatcccaagcctgaggaagtacagacagcacctgaaccggaagctgcacctgacaagatcctgcctgatcgatctgaccatgatgatgtcccagaagctctggaagaaccagcggaagagaatccctctgccatctccacggcaacatctgctgccacagtaccctctgcacccacctccaccttgtctgctgttgctgcaccatagacaccacctggcctttctcgagatggcctgtagctctcagcacacccacagcatcaagatctggatcagcttcagccatgaagtggaccctccaggcagcgtgtggatactgccttgcgatctgcctcggatgctgccaatctcttcacccctgcacagaccccagatgcctttctggacctgcacctttcctgccacaacctggggcacatgggagacaccttctacatggggctggcggactttcagaggcgctagcagcagcacatcccgggacagcagatccttcttcacctctgctcaccctagcaggccctgcagaatgagactgtaccagtgcaagaagaagctcctcctgaaactgctgaccaccaccacaagcagccccagaagatcccctgctctgagagcaagaggcggcaccacaatcggcgaagtgaccagctgtaccaacctgagcgtgcccatgatgctgaccatcctgatttggaagcgggtgttcatcctcctgctgagcgataagaagggcgccaagaagatcaccttcctgcctattcctccacacctgagacaccctctgctgctgttcgagaagaaacggcctgagtggctgagcatggacctggacggaatgctgacagtgatcggccagggactcgtgggcatgacccctagagatctgggaacagtggcaggcgccaccgctcagattcagcgacctatccaggtgcagactggcggcagactcagaagaaacctgcagagaaacctgaaggtgctccaggtgtccgtgtacagcggcaacctgctgtcctttagcagacggggcatgaagtctagcgtgcggctgaaaaaccgcgagtgggagaaacggaagcagattctcggaggcggcggaaagtacaaagagtacttcctgaagcgcatcctcatccggaaggctatgacagtgctggccggcgacaagaaaggactgggcagattcatgagatgcgtgcagagcgagacaaaggccgtgtctctgcaactgcctctgggaagaaacatggaacaccggttgaccatggacagcgccctgagcctgacaaagagagagggacccgagacactcaaaaagaaatacctggtccagcaccagatgaagtgtctgaccgccgtggattgtctgcaggctttttgggacatgggctacccctacgatgtccctgactatgcgtcctaaaggcgcgcctagcggccgc

SEQ ID NO: 1154 - DNA, 5299 bp, Artificial Sequence
  Cloning cassette hINV 4B
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgatccagaagaagaagcagaagtccaacctggacctgcagcaccagcgcagacgcaaaaagaagaaggacaaggtcgagatccggaatcggagccccaaggccaatagcacagagtgtcagggcgagcacagcagagagcagaacctgctgaatctggtgcagctgaaccctcacagccctcaccacagaaaggacgaagaggaccaccagaagcggcaccaccaccacaatcaaaagaaaatgagcgtgatggccaagaagtcccagcagcctctcggacaggcctttggctctctgtgtcagctggtgtccgccgatttcagcgcccctcaagtgaccagactgcggagcctgaaccatctgctgatcaacgagggcaacaaccactggcctagagtggaaatgcctaccggttggctgctcgtgggctacaacaccagaaacacagcccagaatcctcggctgcagcagcacctgaaacactggcagcagtgcaccagagccagatggtgccaagagccttgtcagaccctgaccttcttccatttcttcttctttttcaaaacggtgtccctgtgctgccccggctggtctaaaggacaacctcctccacctggcctgaagccttctagcctggcttctcaggtggccagaaccacaggcgtgtaccagcacgtgtggctgatctgcttcgtgttcttcgtgtgcgtggaaaccggcttctgtcacgtggcccaagtgggactcgagagactggtgtctctgagcggcatcaccgacgtgaaccattgggcccagcctaagccatctcctagcaaaggcaccggcatgaacagacccatcggcctgagagttggcaaaggcgtgtgggccagactgagagcctccgtgtctttctggaccctgctgcctacaacaggcgtgcggacaagaggaagccctctgagactgacactgtggcctccacggaacatcctgaacagcctgcctagcagcatggaaatcgccgtgctgcaagagaaccgcaagaccagaaaggccgccagagagaagcacagaaagaccgacaacctgcacctgtgctactaccacagccagagcaaccggaacaagagccggcagatggaaagcctgggcatgaagctgcagagccctctgtgggattgctccaccacaacaggcacacaccacggctgtctgtgggagatccctagcgttacactgctggcctgcagagtgaacgccgtggaagaactgcacagcaggcggatgtctgtgcggatcgtgaagaactgggtgtcctgctgttacgtgcgcctgtctgctgtgggcctgtctacttggagcgccctggacgtggtcatcaacctgaagcggctgcagaagttcagccagaagtctcagcaccactgcgccctgagaaagatcgagtgggccacaaagctgagcctcggcggaaaagctggaccccaggctcaagagaaggccaacgccaagaagatgcccttccagcggtggatcttcagcaatcagctgaccgtgcagatgctgtgcctgcctattgaagccctgactgccctgttcacctgtcggacagccagcatcagcgtgaacatcagcaccctgatgagcatcctggaagcccctctgttttttcacggcgacctgtgcgaggaaaagaagaacggccggatcagcagccaggctcctctcagactttggtcttggtgcggcacaagccagacctactttggcagcaccgccaagaaaagccccaccagcttttgctgcgagtggggaggacaggctcaccggcagagaaataccggaatggaaatcctgctgtggattctgctcaagatggaaattcagatcttcaagatttgcctgggcgagatgcagctgtgcacctacacaccccacatctgcagacacacctgtagaggcggacctagcgccagcgatagatgctgtagctgtagccctagcggcttcagcgccggaagaggcagatgtccagttcagggatgtctgcggcctcacagagtgcagctgctgagaagatggggccctggatctcctgctggccagagactgtctaagggctttcagctgctccgttggtggggaccaggatctccagctcctgagcctagaaagggcccatttccaccacctgatcctccatggcctgtgaccgctgtgacagtgatggctggctctgtgcctagcgctcagtctgtggatgctctggaaagccctggacctctggcactggaaggacctagcagccccagaaacctgctctggcgggaaatgagcatcttcctgcctggcatcttcacctctcggattctgaacctgcaagtgctgaagaagatcctgcggagctttatgaagctgtaccactctctggtcatgtgcctgcggctgcggaccaagctggaaaaagctctgagcgctctgttcatctggccccagcacagctacaagcagaggcctcctctgcagcctgtgcaggtcgtgctcagactgggaaacctgcctccattcttcagaggcagcgaggtgccctttcctagaccttgccggaccaagatgctgaaccagaagtgtctggcccctttcatcacacacccattcgcctctcagcccctgggacaagagatgcccaacaacacccagatcagactgctgaagcccctgctgacccctgacaccagatggatcttctccaaccagctgcagacagtccagatgctctgtctgccacctctgaagcagggcgagagaatcatttggcccctcggcggctttcagatccccaacttcttttggagcctcggaatcggccacactggcgcctggtggcatactggaaggcggagaagagaatggggcggctccaccgtgtctagaagcccactgtggatcagctccatgatctacctgagaggcatggccttcgccagcgacagctccatcagaaccaccagagtgtcctggtgcagaagatgcggcgccaaatctgccgctgcctccagcctcaagaagaaaccccgggacatctgtcggatcagcgactctaagaagatgacccagaagcgcgagagcaccctgggcaatttctggatgaagctcctccagctgccagacaagaagaagaagtctaccgaaaagaccaagatcatcaagaagatgaagaaacggatcatggtccacatgtgcagctccctggctctgccaacaggcctgacatctctgatcctgccaagcagcgatctggccgtgctgatctctagctccaccagccactttctgatgcggagcccagtgctgcctagctccagactgacttgtgcctctccacagctgcccagaatgtggacctggtccagctggctgaagtggctgaaaaactggaagcggttcaagcttaaaaagaagtacatcctggccatgacgctgaccctgaacgggcatccaagaaccgcctctatcaccctgcctaccaccagcctgaagggctctagaaccagctgttgccccagatctcaccccagactgcctaggacaaagtggcctctgcagtgcctgctgcacagcctgggaacaactggaacactcgtgtgggaaaggggcgtgctgcagatgagaagtctggaagctcactgccctctgcagaccttccacctccaccactgtagaactcagcccagctcttgccctcctgcatggattctgtaccaaggacagtggagcggagccgtcgtgggacttagacctgtggctcaccatctgccaagacctattcagggcctgcactgcccacaggctccacatcaaccagctctgtcttggggcaagtggcccgtgggaatgacaggacctgccagatgttgccggtggcctagacgggaactcaaaaagaatctgctgctcccctgccggtgcagacgcgagtatagagtgacaatgggccaagccttcggcagctttagcgccgactttagcgctccccaggtgttgaagaagaatcggaagcagaacaagattatctgcaagggccaccgcatcacaagcctgatcctgagctttcagcgcgtgaaacttaagaagaaagtcaacgcctgctctcccgcctgcacctctaaagcctggactcccagaaagctcgtggggagagccgtcagaagaaagggcatcatctgtatcaagaatatgttcctgcagcggaagggtttcctgaacctgagccacgtggaaaagttcgtgcctccttctcctcctctggctctcggccctagaatgcagctctgtacccagctggcccggttcttccctatcacacctcctgtgtggcacatcctgggacctcagaggcacaccccttgtcaaaagaaggtgccctccgctagcccatggggccttagaccatctccttgcctgagctggtcctccagaattgtggcccctggacacgccctgagctgtcggactagaagaagatggtccagcaagggctacccctacgatgtccctgactatgcgtcctaaaggcgcgcctagcggccgc

SEQ ID NO: 1155 - protein, 1507 aa, Artificial Sequence
  Assembled poly-FSP polypeptide 1C
STRREMPSQATPSPPGPWRAALGKEVKRSQSKLRLRNTSPTEIQLTMNDSKHKLESPALKQVSPASPPTQQPQTPQDSRQVLAASSPGHPLGPGDCPRTMAGPSASLHPASGRASRKTWQRRLRACRAGGPAGWARQAMTLKALVKTWTQFRNYPRVGAGTGGGPACVPVAEASTGAWTAEGAAGTRCRASRAPCRQLPASSPTKCEICVKRRRRRKRSSQSRSPVPKKRERMMLPVRARTARSALPQGRAPLEGMLLPRALPSLLSRMPARRESRFWLALQALGLRPPHLPSCHPLPQLLGPPPPHQAPFDKKGFVILSKGKKRRKEIRRMTRRTMTTTKMMMMRRTKRRRRKRRRMTMMTRRTLLTKKTCLTPRTSAATKALPRQTISQRRPIQTPPGTSLAIWGRLPLRPQRGPRPLHRWLQQTTGCSQRRIAKKRIKLRRNTLAIRFISAPQPSSSTVTAAPSGQYFSSFFYTSDRTKCEICVKNTAILAITLITPQDPHLDPVCHPHRRPGWKGHHRVVFSHHPSGSTKSHWQQRERGGGRREKKGCREMPSSWSSSGRTADKKNVRSRTRLTLTGTRSSGTRASPSAVCLCCWTCPSRSFPAASPSGLRAPVGAQAPPEVTLRASCASSASKACAGLWPWGAQVRNKVRQNFKRNLAKKTLTNALRSMPKSRNQVLFRRNLTPSQLRTLAPPYMLLPQSLSQSLSRKQIPSQSMLVTAFFLLDIILRSLLYSRMCLVQIPTHTWEPDYFVSLPMMFSWATQSFPVGAVFLTRPAIPCCSCTSHSNPWSQSFKKKKPLTFSPSVPMSLACSITVSFVGQISTLVLDVSSISHWRKRKREKRSQKSRQNHLQLKSCRRKISNWSKLRSPWIFYPRLKTFGVPLGSILCLAGSLSTMMIISTTRQECGRRASVPCRPMIGSARPGPWRTSAMPSAMGVALPTSCESGRSPPATGGRMPGSQSIMMSWMPPLAPCAACPCSPAPTLCPAHPARAPTAVPAFTPLSAHPVPVLSGCHLAVRTSMLTLLPMRHPHRSPPTSCPPLLEAFPLPRASLRATVPRHSSVLATGLHLHRQISLPLRGFLLHQPLPGQHLWLSHRLRLRLPRTGEKNDLQLFVMSDTTYKIYWTVILLNPCGNLHLKTTSLRRARPTSCSTCRMWWLKLAPLQVTTTLKLILVMLEIVTEEAKKSMKRSRRSKIEASPIGSIMKKKDSTIFINQQLKWTPHILKSASVSKKRLPKLNGIWEVMPRTLEGCISVKDHRTSQNHSKCITECVRTALNQRKVVKNPSQPVPLRNDGITNGNDSTRSCSISLKKSLEKMPLMNAKKMEDMIWESNMGGNRSICLTRLPCKVTESSQRPPRSILSLASRAGQFPVWRRTSRGMSLQWKSGNACTPLRCPSRSPATFLTALNGWHRSGLRAQQPSLPGPCASLLSTLSQPPPQAPSQVWTAATLRCPAVPAAACPPIVFFLAPYFPTPLSISRPTSRARQSCCLPGLTHPAHQPLGSM

SEQ ID NO: 1156 - protein, 1501 aa, Artificial Sequence
  Assembled poly-FSP polypeptide 2C
RQINRRKLQRKKRRKKREDHCGLRARNRNMKKTMSHLIAHQALKMSGLRLFHPRLLTRKKPGKNPRRKTWKMRKKYAQKPSQKNHLYGKGLTHPVPLKRTLQNKRNKNIKRVNQKKGNIKRKSILLHLIVLNSPESNLQAHPQVPALAPQAWWPARRGPLTSAPSAQQSLTFLPSRFPWGPPPLHWNSAYLGRTLLVTCILYHRWIVTSMCQSQRWLTSTTSRSSALMWTQWSSVTSLEWTAQERGCSSWLMKQTWMKSWSLRDPSYRSILEYVSTRVLWMPTSTVGALRATAPATAAPQAQTPHWRAATTSSMSSSPRAEPTSSSSWATCWPRCCSSSCYWSLSSWPPAGAAEATNTRTRSRESQRGRMLTWRSSLWLQGTRCFTGVRTSSRHPSWPWTRCLRMRPPRSNSRKKLLEDMKQNGFTRYKKRGVIAWRRATFLLALWECSLPQARLCLIVSRTLLLVQSRCSLMEQIPHLKSWWCTRGGGKRKKKMCKVSGGCTACVERCPWKGICWKWPVTVAALILIQHGGIFTFRFWVEKLSWNICKNLSLYLDKFVQRLLYVYIIETNVFVLNLFHVPVNQIFMMAFYLKYTEKAWVMELEWLIQQQCYQLLLAHMYGFSTYGTQKGECVCLQCLSGSSLFILKQPLDLKISKTFMSRSHLDFSPYWMKKVKASPQIMQRMSAVNFETIRRKWQIRHVLKNLPLENTQIPRTSPLWKITMVLTYPNCVVHVLMFVLFKADQSESSLSSGIYPPSTCSLPCRGIRMCALSHPSFYISSTVCFLSKHCMTACTREKIINPTISCPFQSPTKRLGHREGSESDNLGLLYSFPPWLPMRSLGEPWRAGFQWGESPWQVMASLTGNSVIVHKIVLVFLKSLSSYNCERRISGIQKRAIEFAVLKLLNMDLASPQIMQRTSADRFRMKRRMQNLDNLGVPWPLLPGAAPPHRLLGPSRWILFHVRNIVYGIQVMLCRRRNSRKQSQVQLAIQVLLVDKHKYFLFGPYPISEGLTMTTGRNINSNSLMTNCLFSPIFLCHHAIMHRKMTSPHFRLFSSKIPHPQVPSVVALCKFLANGLWFNLIFQKKGHMIFSPKFFLTFSQRTLESAGLFPWLHTQCRNKKTKLWFSLINIHHRKNPLLPMRMSRTPPRRVCGSPPLHLCQPLRGGKKRSKFAFWKPPSQGISSCLMTGCWGSCGRACSCGRGCGTPRGDWKRHPPRRELSLEPWIPYLHQQKTQRKRMKTGAIQEKGAIQEKGAMTKRICVVNFEACREMESLSAPEKITLFEAHMARCTSINVLCVRASLIEKLMKEKRKMKRNQVASPQIMQRLFIKGYQNNHFTFHLQNFAFFSSFGNNKYINILTRAFIHTPRSPGCSVYANMCWRKMQSLNHPSRLTNCHPAWLSPISACPRLLPYPFHVLALEVTFPPGTAMPQMQLQALAMWEKGWDKQEKKSRKLMSSCLEKKATWMRRTPGTSLQCYLNTHPCTMLLPQGIPSLNAQWMFLRI

SEQ ID NO: 1157 - protein, 1506 aa, Artificial Sequence
  Assembled poly-FSP polypeptide 3C
PIPPHLRHPLLLKNKKRRKLRPKSRKKGHTKNRRKAKRKPQIRNSRRATPTSKGSLRRKYLRVGAAAASCQSPPSPRETTPSSDATRRTRPIAAQSKKTMTAAGLTPSQKKDPAGKLKKQVSVYSGNLLSFSRRGMKSSVRLKNCTNLSVPMMLTILIWKRVFILLLSDKKSIPHVPKATAAHSVTVKLQSRRNRRYRKIYGELKMSLQASNGMEACGTHPTPRLSVSVITMKLWEKHFKGLNWNLVVWILNLKMMLKKKYLVQREWEKRKQILGGGGKYKEYFLKRILIRKAMTVLAGDKKGLGRFMRCVQSETKAVSLQLPLGRMDLDGMLTVIGQGLVGMTPRDLGTVAGATAQIQRPIQVQTGGRLRGPRRKVLMVLWLPANQSLQKSQVFQWVLRTELPLTFSTLLWDSRHDLPRMLPISSPLHRPQMPFWTCTFPATTWGTWETPSTWGWRTFARQPSRPTGRTPTTRLMAPVGSVMSCSLLTQPSPASACTMPPLLHPQWAPHSAGLSPGACRPACTCISMTTISRATWRRNLQRNLKVLRLRIPSLRKYRQQNTRSTNLEKNPSLKKQSQRRGKLSLTTLSFVLIEELLKKSSQLRRSWRNVSRISNIRKLIWTKQRSFLSLFPKLRATEQMTNVGCRLDFHPRSSSGDRVFLVKIQSSPFLARSWNTMQWNNKKMAMTVIAGAHHCQYKLTYTKVWKMNWKKMMIGSQHLLFSPLDSSPLQLLLHPHGKRCNPCCRLTWMSHLNRKLHLTRSCLIDLTMMMSQKLWKNQRKRIPLPSPRQHLLPQYPLHPPPPCLLLLHHRHHLAFLEMACSSQHTHSIKIWISFSHETMSLSNILMKFRLTTTTSSPRRSPALRARGGTTIGEVTSSLFFSHCLCVAPRCPRSAVDISPGPTSPSLASCASVAIGKLALLGASAPCGAAGAREAGRFAVLGTMVMKNMEHRLTMDSALSLTKREGPETGPVYYVCNRMNVSSVLKPFLFTVPIEDMRECTLGRNRMNVSSVLKPCLIPVPICKKKLLLKLLRGASSSTSRDSRSFFTSAHPSRPCRMRLYQMLQKQCCYNLVIKHPLIFRINLRRQGKTKDGVVQSLGFLNQQIILQKEFFICLLMFIKRWKPAATKKGKNSPCCQKKLRVQNQGHLLMILLHNRGPPLHTRFEKKRPEWLSRKSGVMKCWDLCPAFSGRILHQPEMAAMRLMPKFLNSTNSWWTVHKKRGLFHQMKCLTAVDCLQAFWDMSEKKRKLPMIRKIQKRRRTANRNIEITPQRSKAHLKKTSAKGAKKITFLCLRVRCGGWLCGWTPRGWLKKSTKSRLCFFYLLYYLFFLTVCGFTPPPLILWPQAAPGEKLKHCFKAWGVDPPGSVWILPCFLIHLRKVDTHHLQVVTKTVTATTADGQRMRRLKCKACRLRWARPEPAAQAPPKSHFPPHPSGPSRTSSLQLRTYMEMHYGHQAPQVAMLPKLLCRQMLPTLSTLQQRHPQGPCPPPVTPLRVQSVLLLGVPQTA

SEQ ID NO: 1158 - protein, 1507 aa, Artificial Sequence
  Assembled poly-FSP polypeptide 4C
DSKKMTQKNRKTRKAAREKHRKTDNLDLQHQRRRKKKKDKVEIRNRSPKANSTECQGEHSREQNLLNLVQLNPHSPHHRKDEEDHQKRHHHHNQKKMSVNEGNNHWPRVEMPTGWLLVGYNTRNTAQNPRLQQHLKHWQQCTRARWCQEPCQTLTFFHFFFFFKTVSLCCPGWSKGQPPPPGLKPSSLASQVARTTGVYQHVWLICFVFFVCVETGFCHVAQVGLERLVSLSGITDVNHWAQPKPSPSKGTGMNRPIGLRVGKGVWARLWLKNWKRFKLKKKYTGMEILLWILLKMEIQIFKICLGEMQLCLKKKVNACSNAKKMPFQCRCRREYRVTMIQKKKQKSPLFFHGDLCRPSPCLSWSSRIVAPGHALSCRTRRRWSSKMAKKSQQPLCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIFNLHLCYYHSQSNRNKSRQMESLGMKLQITHPFASQPLGQEMPNNTQIRLLKPGQAFGSFSADFSAPQQAPLRLWSWCGTSQTYFGSIEALTALFTCRTASISVNISTLMSILEAILAMTLTLNGSPLWDCSTTTGTHHGCLWEIPSVTLLATAKKSPTSFCCQRPPLQPVEEKKNGRISSVPPSPPLALGPRMQLCTQLARFFPITPPVWHILGPQRHTPLLTPDTRWIFSNQLQTVQMLCLPPLKQGERIIWPLGGFQIPNFFWSLGIGHTGAWWHTGRRRREWGGSTVSRSPLWISSMIYLRGMAFASDSSIRTTRVSWCRRCGAKSAAASSDKKKKSTEKTKNKIICKGHRITQVVLRLGNLPPFFRGSEVPFPRPCRTKCQKKVPSASPWGLHPRTASITLPTTSLKGSRTSCCPRSHPRLPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRRMCSSLALPTGLTSLILPSSDLAVLISSSTSHFLMRSPVLPSSRLTCASPQLPRMWTWSSWLKEWGGQAHRQRNCRVNAVEELHSRRMSVRIVKNWVSCCYVRLSAVGLSTWSALDSLILSFQRVKTSRILNLQVLKKILRSFMKLYHSLVMCLRLRTKLEKALSALFIWPQHSYKGQAFGSLCQLVSADFSAPQVTRLRSLNHLLIRWIFSNQLTVQMLCLPIIKKMKKRIMVHVLKKNRKQIICIKNMFLQRKGFLNLSHVEKFRESTLGNFWMKLLQLPPACTSKAWTPRKLVGRAVRRKGVVINLKRLQKFRASVSFWTLLPTTGVRTRGSPLRLTLWPPRSQKSQHHCALRKIEWATKLSLGGKAGPQAQEKANILNSLPSSMEIAVLQEMLNQKCLAPFELKKNLLLPTYTPHICRHTLKKKPRDICRIS

SEQ ID NO: 1159 - protein, 1507 aa, Artificial Sequence
  Assembled poly-FSP polypeptide 1D
ADKKNVRSASSPGHPLGPRRMTRRTMTTTKMMMMRRTKRRRRKRRRMTMMTRRTLLTKKTCLTPRTSAATKALPRQTISQRRPIQTPPGTSLAIWGRRSKIEASPIGSITPLSISRPTSRARQSCCLPGLTHPAHQPLGSMVGAGTGGGPACVPVAEASTGAWTAEGAAGTRCRASRAPCRQLPASSPTKCEICVKRRRRRKRSSQSRSPVPKKRERMMLPVRARTARSALPQGRAPLEGMLLPRALPSLLSRMPARRESRFWLALQALGLRPPHLPSCHPLPQLLGPPPPHQAPGEKNDLQLFVMSDTTYKIYWTVILLNPCGNLHLKTTSLNAKKMEDMIWESNQQLKWTPHILKSASIAKKRIKLRRNSTRREMPSQATPSPPGPWRAALGKEVKRSQSKLRLRNTSPFDKKGFVILSNMGGNRSICLTIVFFLAPYFPMPSSWSSSGRTRLPLRPQRGPRPLHRWLQQTTGCSQRRGDCPRTMAGPSASLHPASGRASRKTWQRRLRACRAGGPAGWARQARKRKREKRSQKSRQNHLQLKSCRRKISNWSKLRSPWIFEAKKSMKRSQRPPRSILSLFKKKKPLTFSPSVSKKRLPKLKGKKRRKEIQRKVVKNPSQPVPLRNDGITNGNDSTRSCSISLKKSLEKMPLMRSLLYSRMCLVQIPTHTWEPDYFVSLPMMFSWATQSFPVGAVFLTRPAIPCCSCTSHSNPWSQSTLAIRFISAPQPSSSTVTAAPSGQYFALRSMPKSRNQVLFRRNLTPSQLRTLAPPYMLLPQSLSQSLSRKQIPSQSMLVRTRLTLTGTRSSGTRASPSAVCLCCWTCPSRSFPAASPSGLRAPVGAQAPPEVTLRASCASSASKACAGLWPWGAQVRMKKKDSTIFIYPRLKTFGVPLGSILCLAGSLSTMMIISTTRQECGRRASVPCRPMIGSARPGPWRTSAMPSAMGVALPTSCESGRSPPATGGRMPGSQSIMMSWMPPLAPCAACPCSPAPTLCPAHPARAPTAVPAFTPLSAHPVPVLSGCHLAVRTSMLTLLPMMTLKALVKTWTQFRNYPRRHPHRSPPTSCPPLLEAFPLPRASLRATVPRHSSVLATGLHLHRQISLPLRGFLLHQPLPGQHLWLSHRLRLRLPRTTEIQLTMNDSKHKLESPALKQVSPASPPTQQPQTPQDSRQVLAVPMSLACSITVSFVGQISTLVLDVSSISHWNGIWEVMPRTLEGCISVKDHRTSQNHSKCITECVRTALNTKCEICVKNTAILAITLITPQDPHLDPVCHPHRRPGWKGHHRVVFSHHPSGSTKSHWQQRERGGGRREKKGCREASRAGQFPVWRRTSRGMSLQWKSGNACTPLRCPSRSPATFLTALNGWHRSGLRAQTAFFLLDIILRRARPTSCSTCRMWWRLPCKVTESSLAKKTLTNQPSLPGPCASLLSTLSQPPPQAPSQVWTAATLRCPAVPAAACPPLKLAPLQVTTTLKLILVMLEIVTENKVRQNFKRNSSFFYTSDR

SEQ ID NO: 1160 - protein, 1501 aa, Artificial Sequence
  Assembled poly-FSP polypeptide 2D
RKMQSLNHPSRLTNNPRRKTWKMRKKYAQKPSQKNHLYRQINRRKLQRKKSRSHLDFSPYWMKKVKRARNRNMKKTMSHLIAHQALKMSGLRLFHPRLLTRKKPGKQKKGHMIFSRRKWQIRHVLKNLIPSLNAQWMFLRIASPQIMQRTSADRFRMKRRMQNLDNLGVPWPLLPGLLLAHMYGFSTYGTQKGECVCLQCLSGSSLFILKQPLDLKISKTFMASPQIMQRMSAVNFETILQAHPQVPALAPQAWWPARRGPLTSAPSAQQSLTRTLESAGLFPWLHTQCRAFIHTPRSPGCSVYANMCWRYKKRGVIAWRIYPPSTCSLPCRGLILIQHGGIFTFRFWVEKLSWNICKNLSLYLDKFVQRLLYVYIIETNVFVLNLFHVPVNQIFMMAFYLKYTEKAWVMELEWLIQQQCYQRKRMKTGAIQEKGAIQEKGAMTKRICVVNFEACREMESLSAPEKITLFEAHMARCTSINVLCVRASLIEKLMKEKRKMKRNQVASPQIMQRLFIKGYQNNHFTFHLQNFAFFSSFGNNKYINILTFLPSRFPWGPPPLGALRATAPATAAPQAQTPHWRAATTSSMSSSPRAEPTSSSSWATCWPRCCSSSCYWSLSSWPPAGAAEATNTRTRSRESQRGRMLTWRSSLWLQGTRCFTGVRTSSRCSLMEQIPHLKSNSRKKLLEDMKQNGFTRRRNSRKQSQVQLAIQVLLVDKHKYFLFGRATFLLALWECSLPQARLCLIVSRTLLLVQSRHPSWPWTRCLRMRPPRSHWNSAYLGRTLLVTCILYHRWIVTSMCQSQRWLTSTTSRSSALMWTWWCTRGGGKRKKKMCKVSGGCTACVERCPWKGICWKWPVTVAAMSRTPPRRVCGHREGSESDNLGLLYSFPPVLFKADQSESSLSSGNSVIVHKIVLVFLKSLSSYNCERRISGIQKRAIEFAVLKLLNMDLGKGLTHPVPLKRTLQNKRNKNIKRVNQKKGNIKRKSILLHLIVLNSPESNREKIINPTISCPFQSPTKRLGSPPLHLCQPLRPYPISEGLTMTTGRNINSNSLMTNCLFSPIFLCHHAIMHRKMTSPHFRLFSSKIPHPQVPSVVALCKFTHPCTMLLPQGAFWKPPSQGISSCLMTGCWQWSSVTSLEWTAQERGCSSWLMKQTWMKSWSLRDPSYRSILEYVSTRVLWMPTSTVPKFFLTFSQIRMCALSHPSFYISSTVCFLSKHCMTACTPGTSLQCYLNLANGLWFNLIFRNKKTKLWFSLINIHHRKNPLLPMRLEKKATWMRRTELSLEPWIPYLHQQKTQWLPMRSLGEPWRAGFQWGESPWQVMASLTGRRKKREDHCGLQEKKSRKLMSSCAAPPHRLLGPSRWGSCGRACSCGRGCGTPRGDWKRHPPRRILFHVRNIVYGIQVMLCCHPAWLSPISACPRLLPYPFHVLALEVTFPPGTAMPQMQLQALAMWEKGWDKPLENTQIPRTSPLWKITMVLTYPNCVVHVLMFGGKKRSKF

SEQ ID NO: 1161 - protein, 1506 aa, Artificial Sequence
  Assembled poly-FSP polypeptide 3D
QNTRSTNLEKNPSLKKQSQRRGKLSSRKKGHTKNRRKAKRKPQISQKKDPAGKLKKHLNRKLHLTRSCLIDLTMMMSQKLWKNQRKRIPLPSPRQHLLPQYPLHPPPPCLLLLHHRHHLAFLEMACSSQHTHSIKIWISFSHEDLPRMLPISSPLHRPQMPFWTCTFPATTWGTWETPSTWGWRTFGPVYYVCNRMNVSSVLKPFLFTVPIEDMRECTLGRNRMNVSSVLKPCLIPVPILTTLSFVLIEESRRNRRYRKIYGELKMSLQALPLTFSTLLWDSRHTTTTSSPRRSPALRARGGTTIGEVTSRGASSSTSRDSRSFFTSAHPSRPCRMRLYQSNGMEACGTHPTPRLSRGPPLHTRTMSLSNILMKFRLMLQKQCCYNLVIKHPLIFRINLRRQGKTKDGVVQSLGFLNQQIILQKEFFICLLMFIKRWKPAATKTPPPLILWPQAAPVHKKRGLFSLFFSHCLCHQMKCLTAVDCLQAFWDMMIRKIQKRRRTANRLKKKYLVQCTNLSVPMMLTILIWKRVFILLLSDKKCLRVRCGGWLCGWTPRGKNKKRRKLRPKHLKKTSAKVSVITMKLWEKHFKGLNWNLVVWILNLKMMWLKKSTKSRQSSPFLARSWNTMQWNNKKMAMTVIAGAHHCQYKLTYTKVWKMNWKKMMIGSQHLLFSPLDSSPLQLLLHPHGKRCNPCCRLTWMSREWEKRKQILGGGGKYKEYFLKRILIRKAMTVLAGDKKGLGRFMRCVQSETKAVSLQLPLGRRKSGVMKCWDLCPRLDFHPRSSSGGEKLKHCFKAWGLCFFYLLYFEKKRPEWLSVDPPGSVWILPCMDLDGMLTVIGQGLVGMTPRDLGTVAGATAQIQRPIQVQTGGRLFLIHLRKVDTHHLQVVTKTVTATTADGQRMRRLKCKACRLRWARPEPAAQAPPKSHFPPHPSGPSRTSSLQLRPIPPHLRHPLLLKGKNSPCCQKKLRVQNQGHLLMILLHNARQPSRPTGRTPTTRLMAPVGSVMSCSLLTQPSPASACTMPPLLHPQWAPHSAGLSPGACRPACTCISMTTISRATWRLRIPSLRKYRQNIEITPQRSKAQVSVYSGNLLSFSRRGMKSSVRLKNSIPHVPKATAAHSVTVKLQYLFFLTVCGFDRVFLVKICKKKLLLKLLRGPRRKVLMVLWLPANQSLQKSQVFQWVLRTETYMEMHYGHQAPQVAMLPKLLCRQMLPTLSTLQQRHPQGPCPPPVTPLRVQSVLLLGVPQTAAFSGRILHQPEMAAMRLMPKFLNSTNSWWTVAPRCPRSAVDISPGPTSPSLASCASVAIGKLALLGASAPCGAAGAREAGRFAVLGTMVMKGAAAASCQSPPSPRETTPSSDATRRTRPIAAQSKKTMTAAGLTPRRNLQRNLKVLGAKKITFLRNSRRATPTSKGSLRRKYLRVNIRKLIWTKQRSFLSLFPKLRATEQMTNVGCLLKKSSQLRRSWRNVSRISNMEHRLTMDSALSLTKREGPETSEKKRKLP

SEQ ID NO: 1162 - protein, 1507 aa, Artificial Sequence
  Assembled poly-FSP polypeptide 4D
NRKTRKAAREKHRKTDDKKKKSTEKTKNAKKMPFQQRPPLQPVNLDLQHQRRRKKKKDKVEIRNRSPKANSTECQGEHSREQNLLNLVQLNPHSPHHRKDEEDHQKRHHHHNQKKMSVRASVSFWTLLPTTGVRTRGSPLRLTLWPPRVPPSPPLALGPRMQLCTQLARFFPITPPVWHILGPQRHTPQAPLRLWSWCGTSQTYFGSRPSPCLSWSSRIVAPGHALSCRTRRRWSSKRWIFSNQLTVQMLCLPITHPFASQPLGQEMPNNTQIRLLKPCRVNAVEELHSRRMSVRIVKNWVSCCYVRLSAVGLSTWSALDEEKKNGRISSLKKKVNACSSLILSFQRVKTGMEILLWILLKMEIQIFKICLGEMQLCGQAFGSFSADFSAPQIIKKMKKRIMVHELKKNLLLPMCSSLALPTGLTSLILPSSDLAVLISSSTSHFLMRSPVLPSSRLTCASPQLPRMWTWSSWLKNEGNNHWPRVEMPTGWLLVGYNTRNTAQNPRLQQHLKHWQQCTRARWCQEPCQTLTFFHFFFFFKTVSLCCPGWSKGQPPPPGLKPSSLASQVARTTGVYQHVWLICFVFFVCVETGFCHVAQVGLERLVSLSGITDVNHWAQPKPSPSKGTGMNRPIGLRVGKGVWARLILAMTLTLNGMAKKSQQPLQVVLRLGNLPPFFRGSEVPFPRPCRTKPACTSKAWTPRKLVGRAVRRKGSPLWDCSTTTGTHHGCLWEIPSVTLLAHPRTASITLPTTSLKGSRTSCCPRSHPRLPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRRCQKKVPSASPWGLVLKKNRKQMLNQKCLAPFRESTLGNFWMKLLQLPVVINLKRLQKFNLHLCYYHSQSNRNKSRQMESLGMKLQSQKSQHHCALRKIEWATKLSLGGKAGPQAQEKATSRILNLQVLKKILRSFMKLYHSLVMCLRLRTKLEKALSALFIWPQHSYKPLFFHGDLCEWGGQAHRQRNWLKNWKRFKLKKKYIQKKKQKSNKIICKGHRITIICIKNMFLQRKGFLNLSHVEKFCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIFTAKKSPTSFCCNILNSLPSSMEIAVLQEDSKKMTQKGQAFGSLCQLVSADFSAPQVTRLRSLNHLLITYTPHICRHTLLTPDTRWIFSNQLQTVQMLCLPPLKQGERIIWPLGGFQIPNFFWSLGIGHTGAWWHTGRRRREWGGSTVSRSPLWISSMIYLRGMAFASDSSIRTTRVSWCRRCGAKSAAASSIEALTALFTCRTASISVNISTLMSILEALKKKPRDICRISCRCRREYRVTM

SEQ ID NO: 1163 - DNA, 4521 bp, Artificial Sequence
  polynucleotide 1C
agcaccagacgggaaatgccttctcaggccacaccttctccacctggaccttggagagccgctctgggcaaagaagtgaagcggagccagagcaagctgcggctgagaaacacaagccccaccgagatccaattgaccatgaacgacagcaagcacaagctggaaagccccgctctgaaacaggtgtcccctgcctctccacctacacagcagcctcagacaccccaggatagcagacaggtgctggccgcttcttctcctggacatcctcttggccctggcgactgccctagaacaatggctggaccttctgcctctctgcacccagcatctggcagagccagcagaaagacctggcagagaaggctgagagcctgtagagctggtggacctgctggatgggctagacaggccatgacactgaaggccctggtcaagacctggacacagttcagaaactaccccagagtcggagccggaacaggcggaggacctgcttgtgttcctgtggccgaagcttctactggcgcctggacagctgaaggcgctgccggaacaagatgcagagcttctagagccccttgcagacagctgcctgccagctctcctaccaagtgcgagatctgcgtgaagagaaggcggcggagaaagcggagcagccagtctagatctcccgtgcctaagaaacgcgagcggatgatgctgcctgtgcgggccagaacagctagatctgctctgccacaaggcagagcccctctggaaggaatgcttctgcctagagcactgcccagcctgctgagcagaatgccagccagaagagagagccggttttggctggcactgcaggctctgggactcagacctcctcatctgcctagctgtcaccctctgcctcaactgcttggacctcctccacctcatcaggcccctttcgacaagaaaggcttcgtgatcctgagcaagggcaagaagcgccggaaagaaatccggcggatgaccagacggaccatgaccaccaccaaaatgatgatgatgcggcggaccaagcggcggaggcgaaaacgtagaagaatgaccatgatgacccgcagaaccctgctgaccaagaaaacctgtctgacccctagaaccagcgccgccacaaaagctctgcccagacagacaatcagccagcggaggcctatccagacacctcctggaacaagcctggccatctggggcagactgcctctcagaccacagagaggacctcggcctctgcatagatggctgcagcagacaacaggctgctcccagagaagaatcgccaagaagcggatcaagctgaggcggaacacactggccatccggtttatctctgcccctcagcctagcagcagcaccgttacagctgctcctagcggccagtacttcagcagcttcttctacaccagcgaccggaccaagtgtgaaatctgtgtcaagaacaccgccatcctggctatcaccctgatcacccctcaggaccctcacctggaccctgtgtgtcacccacatagaaggcctggctggaagggccaccacagagtggtgtttagccaccatccaagcggctccaccaagagccattggcagcagagagaaagaggcggaggccgcagagaaaaaaagggctgcagagagatgcccagcagctggtctagctctggcagaaccgccgacaaaaagaacgtgcggagcagaaccagactgaccctgacaggcacaagaagcagcggcacaagagcctctccaagcgccgtgtgtctgtgctgttggacatgcccctccagaagcttccctgccgcatctccatctggactgagagcacctgttggagcccaggctcctcctgaagtgacactgagagccagctgtgcctctagcgcctctaaagcctgtgctggactttggccttggggagcccaagtgcggaacaaagtgcggcagaacttcaagcggaacctggccaaaaagaccctgactaacgccctgcggagtatgcccaagagcagaaaccaggtgctgttcagacggaatctgaccccaagccagctgagaactctggcccctccttacatgctgctgccccagtctctgtctcagagcctgtccagaaagcagatccccagccaatcaatgctcgtgaccgccttcttcctgctcgacatcatcctgagaagcctgctgtactcccggatgtgcctggtgcagatccctacacacacctgggagcccgactacttcgtgtccctgcctatgatgttcagctgggccactcagagctttccagtgggagccgtgttcctgaccagacctgccattccttgctgcagctgtaccagccacagcaacccttggagccagtccttcaagaagaagaagcccctgacattcagccccagcgtgccaatgtctctggcctgtagcatcaccgtgtccttcgtgggccagatcagcacactggtgctggacgtgtcctccatctctcactggcgcaagcgcaagagagagaagcggtcccagaagtcccggcagaaccatctgcagctgaagtcctgcagacggaagatcagcaactggtccaagctgagatccccgtggatcttctaccctcggctgaaaaccttcggcgtgccactgggctctatcctgtgtctggcaggctccctgagcacgatgatgatcattagcaccaccagacaagagtgtggcagacgggcctccgtgccttgtagacctatgatcggcagcgctagacccggaccttggcggacatctgctatgccatctgccatgggagtcgccctgcctaccagctgtgaaagcggaagatctcctcctgccaccggcggaagaatgcctggatctcagtctatcatgatgagctggatgcctccactggctccctgtgccgcttgtccttgttctcctgctcctacactgtgccctgctcatcctgcaagagcccctacagccgtgcctgcctttacacctctgtctgctcaccctgtgccagtgctgtctggatgtcacctggccgtgcgcacctctatgctgacactgctgcccatgagacaccctcacagaagcccacctacaagctgccctccactgctggaagctttcccactgccaagggccagcctgagagctaccgtgcctagacacagctctgtgctggccactggactgcatctgcatcggcagattagcctgcctctgaggggcttcctgctgcatcaacctctgcctggacaacacctgtggctgtcccacagactgaggctgagactgccaagaacaggcgagaagaacgacctccagctgttcgtgatgagcgacaccacatacaagatctactggacagtgatcctgctgaacccctgcggcaacctgcacctgaaaaccacatctctgcggagagccagacctacctcctgcagcacatgcagaatgtggtggctgaagctggccccactgcaagtgaccacaacactgaagctgatcctggtcatgctggaaatcgtgaccgaagaggccaagaaatccatgaagagatcccggcggagcaagatcgaggcctctcctatcggctccatcatgaagaagaaagacagcaccatcttcatcaaccagcagctcaagtggacccctcacatcctgaagtctgccagcgtgtccaagaagagactgcccaagctgaacggcatctgggaagtgatgccccggacactggaaggctgcatcagcgtgaaggaccaccggacaagccagaaccacagcaagtgcatcaccgagtgtgtgcggacagccctgaaccagagaaaggtggtcaagaaccccagccagccagtgccactgagaaacgacggcatcaccaacggcaacgactccaccagatcctgctccatcagcctgaagaaaagcctggaaaagatgcccctgatgaacgccaagaaaatggaagatatgatctgggagagcaacatgggcggcaaccggtccatctgcctgacaagactgccctgcaaagtgaccgagtccagccaaagaccacctcggagcattctgtccctggcctctagagccggacagtttcccgtttggcggagaaccagcagaggcatgtccctgcagtggaagtccggcaatgcctgcacacctctgaggtgccctagcagaagccctgccacatttctgaccgcactgaacggctggcacagatctggacttagggctcagcaacctagcctgccaggaccttgtgctagcctgctgtctacactgagccagcctccaccacaggctccaagccaagtttggacagccgccacactgagatgtcccgctgttcctgcagctgcttgccctcctatcgtgttctttctggccccatacttccccacaccactgagcatcagcagacccacctctcgggccagacagtcttgttgtctccccggactgacacaccctgctcaccagcctcttggctctatg

SEQ ID NO: 1164 - DNA, 4503 bp, Artificial Sequence
  polynucleotide 2C
cggcagatcaacagacggaagctgcagagaaagaagcgccggaagaagagagaggaccactgcggactgcgggccagaaaccggaacatgaagaaaaccatgagccacctgatcgcccatcaggccctgaagatgtctggcctgagactgtttcaccccagactgctgacacggaagaagcctggcaagaaccctcggagaaagacctggaagatgcggaagaagtacgcccagaagcctagccagaagaaccacctgtacggcaagggcctgacacaccctgtgcctctgaagagaaccctgcagaacaagcggaacaagaacatcaagcgcgtgaaccagaagaagggcaacatcaagagaaagagcatcctgctgcacctcatcgtgctgaacagccccgagagcaacctgcaggctcatcctcaagttccagcactggctcctcaggcttggtggcctgctagaagaggccctctgacaagcgctccatctgctcagcagagcctgaccttcctgcctagcagatttccttggggccctcctccactgcactggaactctgcctacctgggcagaacactgctcgtgacctgcatcctgtaccacagatggatcgtgaccagcatgtgccagagccagagatggctgaccagcaccacctctagaagcagcgccctgatgtggacccagtggtctagcgtgacaagcctggaatggacagcccaagagaggggctgtagcagctggctgatgaagcagacctggatgaagtcttggagcctgcgggaccccagctacagatccatcctggaatacgtgtccaccagagtgctgtggatgcccacatctacagtgggagccctgagagccacagctcctgcaacagctgctccacaggctcagacccctcattggagagccgccacaacaagcagcatgagcagcagccctagagccgagcctacaagctctagctcttgggccacctgttggcccagatgttgcagctccagctgttactggtccctgtcctcttggcctcctgctggtgctgccgaggccacaaataccaggaccagaagcagagagtcccagcggggcagaatgctgacttggagaagcagcctgtggctgcagggcaccagatgttttacaggcgtgcggacctccagcagacacccttcttggccttggaccagatgcctgagaatgcggcctcctagaagcaacagccggaaaaagctgctcgaggacatgaagcaaaatggcttcacccggtacaagaaacggggcgtgatagcctggcggagagccactttcctgctggccctttgggagtgcagtctgccccaagctagactgtgcctgatcgtgtctaggaccctgctgctggtccagagcagatgcagcctgatggaacagatccctcacctgaagtcctggtggtgtacaagaggcggcggaaagcggaagaaaaagatgtgcaaggtgtccggcggctgcaccgcctgtgttgaaagatgtccttggaagggcatctgctggaagtggcctgtgacagtggccgctctgatcctgattcagcacggcggcatcttcaccttccggttctgggtcgagaagctgtcctggaacatctgcaagaatctgtccctgtacctggacaagttcgtgcagcggctgctgtacgtgtacatcatcgagacaaacgtgttcgtcctgaacctgttccacgtgccagtgaatcagatcttcatgatggccttctacctgaagtacaccgagaaggcctgggtcatggaactggaatggctcattcagcagcagtgctaccagttgctgctggctcatatgtacggcttcagcacctacggcacccagaaaggcgagtgcgtgtgtctgcagtgtctgagcggcagctccctgttcatcctgaagcagccactggacctgaagatcagcaagaccttcatgagcagatcccacctggatttcagcccctattggatgaagaaagtgaaggcctctccacagatcatgcagcggatgagcgccgtgaacttcgagacaatcaggcggaagtggcagatccggcacgtgctgaagaacctgcctctggaaaacacacagatccccaggacaagccctctgtggaagatcacaatggtgctgacataccccaactgcgtggtgcatgtgctgatgttcgtgctgttcaaggccgaccagagcgagtctagcctgagcagcggaatctaccctcctagcacctgtagcctgccttgccggggcattagaatgtgcgccctgtctcaccctagcttctacatcagcagcaccgtgtgctttctgagcaagcactgcatgaccgcctgcaccagagagaagatcatcaaccccaccatcagctgcccctttcagagccccacaaagagactgggccacagagagggcagcgagagcgataatctgggcctgctgtactcctttcctccttggctgcccatgagatccctgggcgaaccttggagagctggctttcagtggggagagtccccttggcaagtgatggctagcctgaccggcaacagcgtgatcgtgcacaagatcgtgctggtgtttctgaagtctctgagcagctacaactgcgagcggcggatctctggcatccagaagagagccatcgagttcgccgtcctgaagctgctgaacatggacctggctagccctcagattatgcagagaaccagcgccgaccggttccggatgaagcggagaatgcagaacctggataacctgggcgtgccctggccattgcttccaggtgctgctcctccacatagactgctgggcccctctagatggattctgtttcatgtgcggaacatcgtgtacggcatccaagtgatgctgtgccggcggagaaacagcagaaagcagagtcaggtgcagctggccattcaggtcctgctcgtggacaagcacaagtactttctgttcggcccctatcctatcagcgagggactgaccatgaccaccggccggaacatcaacagcaactccctgatgaccaactgcctgttcagccccatcttcctgtgccaccacgccatcatgcaccggaagatgacaagcccacacttcagactgttctccagcaagatcccacatcctcaggtgccaagtgtggtggccctgtgcaagttcctggccaatggcctgtggttcaacctgatctttcagaaaaagggccacatgatctttagccccaagttcttcctgacctttagccagcggaccctggaatccgccggactgtttccatggctgcacacccagtgccggaacaaaaagaccaagctgtggttttccctgatcaacatccaccaccgcaagaatcctctgctgcctatgagaatgagcagaacacctcctcggagagtgtgcggatctccacctctgcatctgtgccaacctctgagaggcggcaagaagagaagcaagttcgccttctggaagcctcctagccagggcatcagctcttgtctgatgacaggctgttggggctcctgtggcagagcttgttcttgcggaagaggctgcggtacacccagaggcgactggaaaagacacccacctcgcagagagctgagcctggaaccatggattccttatctgcaccagcaaaagacccagcggaagcggatgaagaccggcgccattcaagagaagggcgctatccaagaaaaaggcgcaatgaccaagcggatctgcgtggtcaatttcgaggcctgcagagagatggaaagcctgagcgcccctgagaagattaccctgttcgaagcccacatggcccggtgcacctccatcaatgtgctgtgtgtccgggccagcctgattgagaagctgatgaaagaaaagcgcaagatgaagcgcaaccaggtggcatcccctcaaatcatgcaacggctgttcatcaagggctaccagaacaaccacttcacgttccacctccaaaactttgccttcttcagctccttcggcaacaacaagtatatcaacattctcacccgggccttcatccacacacctagaagccctggctgttccgtgtacgccaatatgtgctggcggaagatgcagtccctgaatcaccccagcagactgaccaactgtcaccccgcttggctgagccccattagtgcttgtcctaggctgctgccctatccttttcacgtgctggcactggaagtgacctttccacctggcacagccatgcctcagatgcaattgcaggcactggctatgtgggagaaaggctgggacaagcaagagaagaaatcccgcaagctgatgtcctcctgcctggaaaaaaaggctacctggatgcggagaacccctggcacaagcctgcagtgttacctgaacacacacccctgcaccatgctgctgcctcagggaatcccatctctgaacgcccagtggatgttcctgcggatc

SEQ ID NO: 1165 - DNA, 4518 bp, Artificial Sequence
  polynucleotide 3C
cctattcctccacacctgagacaccctctgctgctgaagaacaagaagcggagaaagctgcggcccaagagcagaaagaagggccacaccaagaaccggcggaaggccaagagaaagccccagatcagaaacagccgcagagccacacctaccagcaagggcagcctgagaagaaagtacctgagagtgggagccgccgctgctagctgtcaatctcctccatctcctagagagacaacccctagcagcgacgccaccagaagaaccagacctatcgccgctcagagcaagaaaaccatgacagccgccggactgacccctagccagaagaaagatcctgccggcaagctgaagaaacaggtgtccgtgtacagcggcaacctgctgagcttctctcggagaggcatgaagtctagcgtgcgcctgaagaactgcaccaacctgagcgtgcccatgatgctgaccatcctgatctggaagcgggtgttcatcctgctgctgtccgacaagaaatctatccctcacgtgcccaaggccaccgccgctcattctgtgacagtgaagctgcagagccggcggaacagacggtacagaaagatctatggcgagctgaagatgtccctgcaggccagcaatggcatggaagcctgtggcacacaccccacacctagactgtccgtgtccgtgatcaccatgaagctgtgggagaagcacttcaagggcctgaactggaacctggtcgtgtggattctgaacctgaagatgatgctcaagaagaagtatctggtccagcgcgagtgggagaaacggaagcagattcttggcggcggaggcaagtacaaagagtacttcctgaagagaatcctcatccgcaaggccatgacagtgctggccggcgataagaaaggcctgggcagattcatgagatgcgtgcagagcgagacaaaggccgtcagtctgcagctgcctctgggcagaatggacctggatggaatgctgaccgtgatcggccagggactcgtgggcatgacacctagagatctgggaacagtggctggcgccaccgcacagattcagaggcctattcaggtgcagacaggcggcagactgagaggccctagaagaaaggtgctgatggtgctgtggctgcccgccaatcagagcctgcagaaaagccaggtgttccagtgggtgctgagaaccgagctgcccctgacctttagcaccctgctgtgggacagcagacacgacctgcctagaatgctgcccatcagcagccctctgcacagaccccagatgcctttctggacctgcacctttcctgccaccacatggggcacatgggagacaccttctacatggggctggcggacctttgccagacagccttctagacccaccggcagaacccctaccaccagactgatggctccagtgggcagcgtgatgagctgtagcctgctgacacagccatctccagccagcgcctgtacaatgcctccactgctgcatcctcagtgggcccctcattctgctggactttctccaggcgcttgcagacctgcctgtacctgcatcagcatgaccacaatcagcagggccacctggcgcagaaacctgcagagaaacctgaaagtgctgcggctgagaatccccagcctgcggaagtacagacagcagaacacccggtccaccaacctcgagaagaacccatctctgaagaagcagagccagaggcggggcaagctgtctctgaccacactgagcttcgtgctgatcgaggaactgctgaaaaagagcagccagctgcggagaagctggcggaacgtgtccagaatcagcaacatccggaagctgatttggaccaagcagcggagcttcctgtctctgttccccaagctgagagccaccgagcagatgaccaatgtgggctgtagactggattttcaccccagaagcagctccggcgacagagtgttcctggtcaagatccagagcagcccattcctggccagatcctggaataccatgcagtggaacaacaagaaaatggccatgactgtgatcgctggcgcccaccactgtcagtacaagctgacctacaccaaagtgtggaagatgaattggaagaaaatgatgatcggcagccagcacctcctgttctccccactggatagctctccactccagctgctgctgcacccacacggcaagagatgcaacccctgttgtcggctgacatggatgagccacctgaatcggaagctgcacctcaccaggtcctgcctgatcgacctgaccatgatgatgagccagaaactgtggaagaatcagcggaagcgcatccctctgccttctccaagacagcatctgctgcctcagtatcctctgcaccctcctccaccttgtctgctgcttctccaccatagacaccacctggcattcctcgagatggcctgtagctctcagcacacccacagcatcaagatctggatcagcttcagccacgagacaatgagcctgtccaacatcctgatgaagttccggctgaccaccaccacaagcagccccagaagaagccctgctctgcgagctagaggcggcacaacaatcggcgaagtgaccagcagcctgttctttagccactgcctgtgcgtggcccctagatgtcctagatctgccgtggacatcagccccggacctacatctccttctctggcctcttgtgcctctgtggccattggaaagctggcactgcttggcgcctctgctccttgtggtgctgctggcgctagagaggccggaagatttgctgtgctgggcaccatggtcatgaagaacatggaacacagactgaccatggacagcgccctgagcctgacaaagagagagggccctgaaacaggccccgtgtactacgtgtgcaaccggatgaatgtgtccagcgtgctgaagcctttcctgttcaccgtgcctatcgaggacatgagagagtgcaccctgggacgcaacagaatgaatgtctcttccgtgctgaaaccctgtctgatccccgtgccaatctgcaagaagaaactgctgctcaagctgctgaggggcgcctccagctctaccagcagagatagcagaagctttttcaccagcgctcaccccagcagaccctgcaggatgagactgtaccagatgctgcagaagcagtgctgctacaacctcgtgatcaagcaccctctgatcttccggatcaacctgcggagacagggcaagaccaaagacggcgttgtgcagagcctgggcttcctgaaccagcagatcatcctccagaaagagttcttcatctgcctgctgatgttcatcaagcggtggaagccagccgccaccaagaagggcaagaacagcccctgctgccagaaaaaactgcgggtgcagaaccagggccatctgctgatgattctgctgcacaacagaggcccacctctgcataccagattcgagaaaaagcggcccgagtggctgagcagaaaatccggcgtgatgaagtgctgggatctgtgccctgccttcagcggcaggattctgcaccagccagaaatggccgccatgagactgatgcccaagttcctgaactccaccaacagctggtggacagtgcacaagaagagaggcctgttccaccagatgaagtgtctgaccgccgtggactgtctgcaggccttctgggatatgagcgagaagaaacgcaagctgcctatgattcgcaaaatccagaagcggcggagaaccgccaaccggaacatcgagatcacccctcagagaagcaaagcccacctgaagaaaacctccgccaagggcgccaagaaaatcaccttcctgtgcctgagagtcagatgcggaggctggctgtgtggctggacaccaagaggatggctgaagaagtccaccaagtccagactgtgcttcttctacctgctgtactacctgtttttcctgaccgtgtgcggcttcacccctccaccacttattctgtggcctcaggcagcccctggcgagaagctgaagcactgttttaaagcctggggcgtcgaccctcctggcagcgtttggattctgccctgcttcctgattcacctgagaaaggtggacacccaccacctccaggtggtcaccaaaacagtgaccgccacaacagccgacggccagaggatgagaaggctgaagtgcaaggcctgccggctgagatgggctagacctgaacctgcagctcaggcccctcctaagagccactttccacctcatcctagcggcccctccagaaccagctctctgcaattgagaacctacatggaaatgcactacggccatcaggccccacaggtggcaatgctgcctaaactgctgtgtcggcagatgctccccactctgtctaccctgcagcagagacatcctcagggcccatgtcctcctccagtgacacctctgagagtgcagtctgtgctgctgctcggagtgcctcaaacagct

SEQ ID NO: 1166 - DNA, 4521 bp, Artificial Sequence
  polynucleotide 4C
gacagcaagaagatgacccagaagaaccgcaagacccggaaggccgccagagagaagcacagaaagaccgacaacctggacctgcagcaccagcgcagacgcaaaaagaagaaggacaaggtcgagatccggaatcggagccctaaggccaatagcaccgagtgtcagggcgagcacagcagagagcagaacctgctgaacctggtgcaattgaaccctcacagccctcaccaccggaaggacgaggaagatcaccagaagagacaccaccaccacaatcaaaagaagatgtccgtcaacgagggcaacaaccactggcctagagtggaaatgcctaccggctggctgctcgtgggctacaacaccagaaacacagcccagaatcctcggctgcagcagcacctgaaacactggcagcagtgcaccagagccagatggtgtcaagagccctgtcagaccctgaccttcttccacttcttcttctttttcaaaacggtgtccctgtgctgccccggctggtctaaaggacaacctcctccacctggcctgaagccttctagcctggcttctcaggtggccagaaccacaggcgtgtaccagcacgtgtggctgatctgcttcgtgtttttcgtgtgcgtggaaaccggcttctgtcacgtggcccaagtgggactcgagagactcgttagcctgagcggcatcaccgacgtgaaccattgggcccagcctaagccatctcctagcaaaggcaccggcatgaacagacccatcggcctgagagttggcaaaggcgtgtgggctagactgtggctgaagaactggaagcggttcaagctcaaaaagaaatacacaggcatggaaatcctgctgtggattctgctgaagatggaaattcagatcttcaagatttgcctgggcgagatgcagctgtgcctcaagaagaaagtcaacgcctgcagcaacgccaagaaaatgcccttccagtgccggtgcagacgcgagtacagagtgaccatgattcagaagaagaaacagaagtccccgctgttcttccacggcgacctgtgcagaccttctccttgcctgtcttggagcagcaggatcgtggctcctggacacgccctgagctgtcggactcgtagaagatggtccagcaagatggccaagaagtcccagcagcctctgtgtagaggcggcccttctgccagcgatagatgctgtagctgtagccccagcggctttagcgctggaagaggcagatgtcctgtgcagggatgtctgaggccacacagagttcagctgctgagaagatggggccctggatctcctgctggccagagactgtctaagggcttccaactgctgcgttggtggggaccaggatctccagctcctgagcctagaaagggcccatttccaccacctgatcctccatggcctgtgaccgctgtgacagtgatggctggctctgtgcctagcgctcagtctgtggatgctctggaatcccctggacctctggctctcgaaggccctagcagccctagaaacctgctctggcgggaaatgagcatcttcctgcctggcatcttcaacctgcacctgtgctactaccacagccagagcaaccggaacaagagccggcagatggaatccctgggcatgaagctgcagatcacacacccattcgccagccagccactgggccaagagatgcccaacaacacccagatcagactgctgaagcccggccaggcctttggcagcttttccgccgatttttcagcccctcagcaggcccctctgagactgtggtcttggtgcggcacaagccagacctacttcggctctatcgaagccctgacagccctgttcacctgtagaaccgccagcatcagcgtgaacatcagcaccctgatgagcatcctggaagccatcctggccatgacactgaccctgaatggcagccctctgtgggactgcagcacaacaacaggcacacaccacggctgcctgtgggagatcccttctgttaccctgctggctaccgccaaaaagagccctaccagcttctgctgtcagcggcctcctctgcagccagtggaagagaagaagaacggccggatcagcagcgtgccaccttctccacctcttgctctgggccctagaatgcagctctgcacccagctggcccggttcttccctattacacctcctgtgtggcacatcctgggacctcagagacacacccctctgctgacccctgacaccagatggatcttctccaaccagctgcagaccgtgcagatgctgtgtctgcctccactgaagcagggcgagagaatcatctggcctctcggcggctttcagatccccaacttcttttggagcctcggcatcggacacactggcgcctggtggcatactggaaggcggagaagagaatggggcggcagcaccgtgtctagaagcccactgtggatcagctccatgatctacctgagaggcatggccttcgcctccgacagcagcatcagaaccaccagagtgtcctggtgtcggagatgtggcgccaaaagcgccgcagccagcagcgacaagaagaagaaaagcaccgaaaagaccaagaacaagatcatctgcaagggccacagaatcacccaggtggtgctgagactgggcaacctgcctccattcttcagaggcagcgaggtgccctttcctagaccttgccggaccaagtgccagaagaaggttccaagcgcctctccttggggactgcacccaagaacagcctccatcacactgcctaccaccagcctgaagggcagcagaacaagctgctgccccagatctcaccccagactgcccagaacaaagtggcctctgcagtgcctgctgcacagcctgggaacaactggaacactcgtgtgggaaaggggcgtgctgcagatgagaagtctggaagctcactgccctctgcagacattccacctccaccactgcagaacccagcctagctcttgtcctccagcctggattctgtaccaaggacagtggagcggagccgtcgtgggacttagacctgtggctcaccatctgccaagacctatccaggggctgcactgtcctcaggctcctcatcaaccagctctgtcctggggaaagtggcccgtgggaatgacaggacccgccagatgttgccggtggcctagaagaatgtgtagctctctggccctgccaaccggcctgacatctctgatcctgcctagcagtgatctggccgtgctgatctctagctccaccagccactttctgatgcggagcccagtgctgccaagcagcagactgacatgtgcctctccacagctgcctcggatgtggacatggtctagctggctgaaagagtggggaggacaggcccacagacagcggaactgtagagtgaacgccgttgaggaactgcacagcaggcggatgtctgtgcggatcgtgaagaattgggtgtcctgctgttacgtgcggctgagtgcagtgggactgtctacttggagcgccctggattccctgatcctgtccttccagagagtgaaaaccagccggatactgaacctccaggtgctgaagaagatcctgcggagctttatgaagctgtaccactctctcgtgatgtgcctgcggctgcggaccaagctggaaaaagctctgagcgctctgtttatctggccccagcacagctacaaaggccaggcattcggaagcctgtgccagctggtgtctgccgatttcagcgcccctcaagtgaccagactgcggagcctgaaccatctgctgattcggtggatctttagcaatcagctgacagtccaaatgctctgcctgccgatcatcaagaaaatgaagaaacggatcatggtgcacgtcttgaagaagaatcggaagcagattatctgtatcaagaatatgttcctgcagcggaagggattcctgaacctgagccacgtggaaaagttcagagagagcaccctgggcaatttctggatgaagctcctgcagctgccaccagcttgcacctctaaggcctggacacccagaaagcttgtggggagagccgtgcggagaaagggcgtcgtgatcaacctgaagagactgcagaaattccgggctagcgtgtccttctggactctgctgcctacaacaggcgtgcggacaagaggctctccactgagactgactctgtggcctccaagaagccagaaaagccagcaccactgcgccctgagaaagatcgagtgggccacaaagctgtccctcggcggcaaagcaggaccacaggctcaagagaaggccaacatcctgaacagcctgccttcctctatggaaatcgccgtgctgcaagaaatgctgaaccagaagtgtctggcccctttcgagcttaagaagaacctcctgctgccaacctacacaccccacatctgtcggcacacccttaaaaagaagcccagagacatctgcagaatcagc

SEQ ID NO: 1167 - DNA, 4521 bp, Artificial Sequence
  polynucleotide 1D
gccgacaagaaaaacgtgcggagcgctagttctcctggacatcctcttggccccagaagaatgaccagacggaccatgaccaccaccaaaatgatgatgatgcggcggaccaagcggcggagaagaaaaagacgccggatgaccatgatgaccagaagaaccctgctgaccaagaaaacctgtctgacccctagaaccagcgccgccacaaaagctctgcccagacagacaatcagccagcggaggcctatccagacacctcctggaacaagcctggccatctggggcagaagaagcaagatcgaggcctctcctatcggcagcatcacccctctgagcatcagcagacctaccagcagagccagacagagctgttgcctgcctggactgacacaccctgctcatcagcctctgggctctatggttggagctggaacaggcggaggacctgcttgtgtgcctgtggccgaagcttctacaggcgcttggacagctgaaggcgctgccggcacaagatgtagagccagcagagccccttgcagacagctgcctgcttctagccctaccaagtgcgagatctgcgtgaagagaagaaggcggcgcaagcggagcagccagtctagatctcccgtgcctaagaaacgcgagcggatgatgctccctgtgcgggccagaacagctagatctgctctgccacaaggcagggctcctctggaaggaatgcttctgcctagagcactgcccagcctgctgagcagaatgcctgccagaagagagagcagattctggctggccctgcaggcccttggactcagacctcctcatctgcctagctgtcaccctctgcctcaactgcttggacctcctccacctcatcaggcccctggcgagaaaaacgacctgcagctgttcgtgatgagcgacaccacctacaagatctactggaccgtgatcctgctgaacccctgcggcaacctgcacctgaaaaccaccagcctgaacgccaagaaaatggaagatatgatctgggagagcaaccagcagctgaagtggacccctcacatcctgaagtccgcctctatcgccaagaagcggatcaagctgcggcggaacagcaccagacgggaaatgccttctcaggccacaccttctccacctggaccttggagagccgctctgggcaaagaagtgaagcggagccagagcaagctgagactgagaaacacaagccccttcgacaaaaagggctttgtgatcctgagcaacatgggcggcaaccggtctatctgcctgaccatcgtgttctttctggccccttacttccccatgcctagcagctggtctagcagcggcagaaccagactgcctctgaggccacagagaggccctagacctctgcatagatggctgcagcagaccaccggctgctctcagagaagaggcgactgcccaagaaccatggccggaccatctgcttctctgcaccctgcatctggcagagcctccagaaagacctggcagagaaggctgagagcctgtagagcaggcggacctgctggatgggctagacaggccagaaaacgcaagagagagaagcggtcccagaagtccagacagaaccatctgcagctgaaaagctgcagacggaagatcagcaactggtctaagctgcggagcccctggatcttcgaggccaaaaagagcatgaagagatcccagcggcctcctcggagcatcctgagcctgttcaagaagaagaagcccctgacattcagccccagcgtgtccaagaagaggctgcctaagctgaagggcaagaaacgccggaaagaaatccagcggaaggtggtcaagaaccccagccagcctgtgccactgagaaatgacggcatcaccaacggcaacgacagcacccggtcttgcagcatcagcctgaagaaaagcctggaaaagatgcccctgatgcggagcctgctgtactccagaatgtgcctggtgcagatccccacacacacctgggagcccgactactttgtgtccctgcctatgatgttcagctgggccacacagagctttccagtgggcgccgtgtttctgaccagacctgccattccttgctgtagctgtaccagccactccaatccttggagccagtccacactggccatccggtttatctctgcccctcagccaagcagcagcaccgttacagctgctcctagcggccagtattttgccctgcggagtatgcccaagagccggaaccaggtgctgtttcggagaaatctgaccccaagccagctgcggacactggcccctccatatatgctgctgcctcagtctctgtcccagagcctgtctcggaagcagatcccatctcagtccatgctcgtgcggaccaggctgacactgacaggcactagaagctccggcaccagagcctctccatctgccgtgtgtctgtgctgctggacatgccccagcagaagctttcctgccgcctctccaagcggactgagagcacctgttggagcacaggctcctccagaagtgacactgagagccagctgtgccagctccgccagcaaagcttgtgcaggactttggccttggggagcccaagtgcggatgaagaagaaggacagcaccatcttcatctaccccaggctgaaaaccttcggcgtgccactgggcagcattctgtgtctggctggaagcctgagcacgatgatgatcattagcaccaccagacaagagtgcggcagacgggccagcgtgccctgtagacctatgatcggaagcgccagacctggaccatggcggacaagtgctatgccttctgccatgggagtcgccctgcctaccagctgtgaaagcggaagatctcctcctgccaccggcggaagaatgccaggatctcagtctatcatgatgagctggatgcctccactggctccctgcgctgcttgtccttgttctcctgctcctacactgtgccctgctcaccctgctagagcaccaacagccgtgcctgcctttacacccctgtctgctcatcctgtgccagtgctgtctggatgtcacctggctgtgcggacctccatgcttaccttgctgccaatgatgaccctgaaggccctggtcaagacatggacccagttcagaaactaccccagacggcaccctcacagaagcccaccaacaagctgtcctccactgctcgaggcctttccactgccaagagccagcctgagagctaccgtgcctagacactctagcgtgctggccacaggactgcatctgcataggcagattagcctgcctctgcggggcttcctgctgcatcaaccactgccaggacaacacctgtggctgtcccacagactgagactgcggctgcctagaacaaccgagatccagctgaccatgaacgactccaagcacaagctggaaagccccgctctgaaacaggtgtccccagctagtcctcctacacagcagcctcagacaccccaggattctagacaggtgctggccgtgcctatgagcctggcctgtagcatcaccgtgtccttcgtgggccagatctctaccctggtgctggacgtgtcctccatcagccactggaacggcatctgggaagtgatgcccagaacactggaaggctgcatctccgtgaaggaccaccggacatcccagaaccacagcaagtgcatcaccgagtgtgtgcggacagccctgaacaccaagtgtgaaatttgtgtgaagaacaccgccatcctggctatcaccctgatcaccccacaggaccctcacctggaccctgtgtgtcatccccatagaaggcccggctggaagggacaccacagagtggtgtttagccaccatccttccggcagcaccaagtctcactggcagcagagagaaagaggcggaggccgcagagaaaagaagggctgtagagaggcaagcagagccggccagtttcctgtgtggcggagaacatctagaggcatgtccctgcagtggaagtccggcaatgcctgcacacctctgagatgtcccagcagatctccagccaccttcctgactgccctgaacggctggcatagatctggactgagggcccagaccgccttctttctgctggacatcatcctgcggagagcccggcctacaagctgcagcacatgtagaatgtggtggcggctgccctgcaaagtgaccgaaagctccctggccaagaaaaccctgaccaatcagcctagcttgcccggaccttgtgctagcctgctgtctacactgagccagccaccacctcaggctcctagccaagtttggacagccgctacactgcggtgtcctgctgtgcctgctgctgcatgtccacctctgaagctggctccactgcaagtgaccacaacactgaagctgatcctggtcatgctggaaatcgtgaccgagaacaaagttcggcagaacttcaagcggaactccagcttcttctacaccagcgacaga

SEQ ID NO: 1168 - DNA, 4503 bp, Artificial Sequence
  polynucleotide 2D
cggaagatgcagagcctgaatcaccccagcagactgaccaacaatcctcggagaaagacctggaagatgcggaagaagtacgcccagaagcctagccagaagaaccacctgtaccggcagatcaaccggcgcaagctgcagagaaagaagtccagaagccacctggacttcagcccctactggatgaagaaagtgaagcgggccagaaaccggaacatgaagaaaaccatgagccacctgatcgcccatcaggccctgaagatgtctggcctgagactgtttcaccccagactgctgaccagaaagaagcccggcaagcagaaaaagggccacatgatcttcagccggcggaagtggcagatccggcacgtgctgaagaatctgatccccagcctgaacgcccagtggatgttcctgagaatcgctagcccacagatcatgcagagaaccagcgccgaccggttccggatgaagcggagaatgcagaacctggacaatctgggcgtgccctggcctctgttgcctggattgctgctggcccatatgtacggcttcagcacctacggcacccagaaaggcgagtgcgtgtgtctgcagtgtctgagcggcagcagcctgttcatcctgaagcagcccctggacctgaagatctccaagaccttcatggccagccctcagattatgcagcggatgagcgccgtgaacttcgagacaatcctgcaggcccatcctcaggtgccagctcttgctcctcaagcttggtggcccgctagaagaggccctctgacatctgctccaagcgcacagcagtccctgacacggacactggaaagcgccggactgtttccttggctgcacacccagtgccgggccttcattcacacacctagaagccctggctgcagcgtgtacgccaacatgtgctggcggtacaagaaacggggagtgatcgcctggcggatctaccctcctagcacatgcagcctgccttgcagaggcctgatcctgattcagcacggcggcatcttcaccttccggttctgggtcgagaagctgagctggaacatctgcaagaacctgagcctgtacctggataagttcgtgcagcggctgctgtacgtgtacatcatcgagacaaacgtgttcgtgctgaacctgttccacgtgccagtgaaccagatcttcatgatggccttctacctgaagtacaccgagaaggcctgggtcatggaactggaatggctgatccagcagcagtgctaccagcggaagagaatgaagaccggcgccatccaagagaagggcgctattcaagagaaaggggccatgaccaagcggatctgcgtggtcaatttcgaggcctgcagagagatggaaagcctgagcgcccctgagaagatcaccctgtttgaagcccacatggcccggtgcaccagcatcaatgtgctgtgtgtcagggccagcctgatcgagaaactgatgaaagaaaagcgcaagatgaagcgcaaccaggtggcatcccctcaaatcatgcaacggctgttcatcaagggctaccagaacaaccacttcacgttccacctccaaaacttcgccttcttcagctccttcggcaacaacaagtatatcaacatcctgacctttctgcccagcagattcccttggggacctcctccactgggagcccttagagctacagctcctgctacagctgctccccaggcacagacacctcattggagagccgccaccacaagcagcatgagcagctctccaagagccgagcctaccagctctagctcttgggccacttgctggcctagatgctgcagctccagctgctattggagcctgtctagctggcctcctgctggcgctgccgaagccacaaataccagaaccagaagccgcgagagccagcggggaagaatgctgacttggagaagctccctgtggctgcagggcaccagatgttttacaggcgtgcggaccagctccaggtgcagcctgatggaacagatccctcacctgaagtctaacagccggaagaaactgctcgaggacatgaagcagaacggcttcaccagacggcggaacagcagaaagcagagccaagtgcagctggccatccaggtgctgctggtggacaagcacaagtactttctgttcggcagagccacatttctgctggctctgtgggagtgtagcctgcctcaggctagactgtgcctgatcgtgtctagaaccctgctgctcgtgcagtctagacacccaagctggccttggaccagatgcctgagaatgcggcctccacgcagccactggaactctgcctacctggggagaacactgctcgtgacctgcatcctgtaccacagatggatcgtgaccagcatgtgccagagccagagatggctgacctccaccacctctagaagctctgccctgatgtggacctggtggtgtacaagaggtggcggcaagcggaagaaaaagatgtgcaaggtgtccggcggctgcaccgcctgtgttgaaagatgtccttggaagggcatctgttggaagtggcctgtgacagtggccgccatgagcagaacacctccaagacgcgtgtgcggccacagagagggcagcgagtctgataatctgggcctgctgtactcctttccacctgtgctgttcaaggccgaccagagcgaaagctctctgagcagcggcaacagcgtgatcgtgcacaagatcgtgctggtgttcctgaagtccctgagcagctacaactgcgagagaagaatcagcggcatccagaagagagccatcgagttcgccgtcctgaagctgctgaacatggacctcggcaagggactgacacaccccgtgcctctgaagaggaccctgcagaacaagcggaacaagaacatcaagcgggtcaaccagaagaagggcaacatcaagaggaagtccatcctgctgcatctgattgtgctgaacagccccgagagcaaccgggaaaagatcatcaaccccaccatcagctgcccctttcagagccccacaaagagactgggaagccctcctctgcacctgtgtcagcctctgaggccctatcctatcagcgagggcctgaccatgaccaccggcagaaacatcaacagcaactccctgatgaccaactgcctgttcagccccatcttcctgtgccaccacgccatcatgcaccggaagatgacaagccctcacttcagactgttctccagcaagatcccacatccacaggtcccaagtgtggtggccctgtgcaagtttacacacccctgcaccatgctgctgccccaaggcgctttttggaagcctcctagccagggcatctccagctgtctgatgacaggctgttggcagtggtccagcgtgacaagcctggaatggacagcccaagagagaggctgttcctcctggctgatgaagcaaacatggatgaagtcttggtccctgcgggaccccagctacagatccatcctggaatacgtgtccacacgggtgctgtggatgcccacctctaccgtgcctaagttctttctgaccttcagccagatccggatgtgcgccctgtctcaccctagcttctacatcagctccaccgtgtgctttctgagcaagcactgcatgaccgcctgcacacctggaaccagcctgcagtgttacctgaacctggccaacggcctgtggttcaacctgatcttccggaacaaaaagaccaagctgtggttctccctgattaacatccaccaccgcaagaacccactgctgcccatgcggctggaaaaaaaggccacttggatgcggcggaccgagctgtctctggaaccttggattccttacctgcatcagcagaaaacccagtggctccccatgagaagcctgggcgagccttggcgagctggatttcagtggggagagtctccctggcaagtgatggcctctctgacaggcagacgcaagaaaagagaggatcactgcggactgcaagagaaaaaaagccggaagctgatgtccagctgcgccgctcctccacatagactgctgggacctagcagatggggaagctgtgggagagcctgttcttgtggcagaggctgtggaacccctagaggcgactggaagagacacccacctcggcggattctgtttcacgtgcggaacatcgtgtacggaatccaagtgatgctgtgctgtcaccccgcctggctgtctccaatcagcgcttgtcctcgcctgctgccttatccattccacgttctggccctggaagtgacattccctccaggcactgccatgcctcagatgcaattgcaggcactggcaatgtgggagaaaggctgggacaagcctctggaaaacacacagatccccaggacaagcccactgtggaagatcacaatggtgctgacataccccaactgcgtggtgcacgtcctgatgttcggcggcaagaagcggagcaagttc

SEQ ID NO: 1169 - DNA, 4518 bp, Artificial Sequence
  polynucleotide 3D
cagaacaccagaagcaccaacctggaaaagaaccccagcctgaagaagcagagccagcggagaggaaagctgagcagcagaaagaagggccacaccaagaaccggcggaaggccaagagaaagccccagatcagccagaagaaggaccctgccggcaagctgaagaaacacctgaaccggaagctgcacctgaccagatcctgcctgatcgacctgaccatgatgatgagccagaagctgtggaagaaccagcgcaagagaatccctctgccttctccacggcagcatctgctgcctcagtatccactgcatcctccacctccatgcctgctgctgctccaccacagacaccatctggcctttctcgagatggcctgcagcagccagcacacccacagcatcaagatctggatcagcttcagccacgaggacctgcctagaatgctgcccatcagcagccctctgcacagaccccagatgcctttctggacctgcacctttcctgccaccacatggggcacatgggagacaccttctacatggggctggcggacattcggccctgtgtactacgtgtgcaaccggatgaacgtgtccagcgtgctgaagcctttcctgttcaccgtgcctatcgaggacatgagagagtgcaccctgggcagaaacagaatgaatgtgtcctctgtgctgaaaccctgtctgatccccgtgccaatcctgaccacactgagcttcgtgctgatcgaggaaagccggcggaacagacggtacagaaagatctacggggagctgaagatgtccctgcaggccctgcctctgacctttagcacactgctgtgggacagcagacacaccaccaccacaagcagccccagaagatcccctgctctgagagctagaggcggcaccacaatcggcgaagtgacaagcagaggcgccagcagctctaccagcagagacagcagaagctttttcaccagcgctcaccccagcagaccctgcagaatgagactgtaccagagcaacggcatggaagcctgcggcacacaccctacacctagactgtctagaggccctccactgcacaccagaaccatgagcctgagcaacatcctgatgaagttccggctgatgctgcagaagcagtgctgctacaacctcgtgatcaagcaccctctgatcttccggatcaacctgcggagacagggcaagaccaaagacggcgttgtgcagagcctgggcttcctgaaccagcagatcatcctgcagaaagagttcttcatctgcctgctgatgttcatcaagcggtggaagccagccgccacaaagacacctccaccactgattctgtggcctcaggccgctcctgtgcacaagaagagaggcctgttcagcctgttcttctcccactgcctgtgccaccagatgaagtgcctgaccgccgtggattgtctgcaggccttctgggacatgatgattcgcaagatccagaagcggcggagaaccgccaaccggctgaaaaagaaatacctggtgcagtgtaccaacctgagcgtgcccatgatgctgaccatcctgatctggaagcgggtgttcatcctcctgctgagcgacaagaagtgtctgagagtcagatgcggcggatggctgtgtggctggacacctagaggcaagaacaagaagcggagaaagctgcggcccaagcacctgaagaaaaccagcgccaaggtgtccgtgatcaccatgaagctctgggagaagcacttcaagggcctgaactggaacctggtcgtgtggattctgaacctgaagatgatgtggctcaagaagtccaccaagagcagacagagcagcccattcctggctcggagctggaataccatgcaatggaacaacaagaaaatggccatgaccgtgatcgctggcgcccaccactgtcagtacaagctgacctacaccaaagtgtggaagatgaattggaagaaaatgatgatcggctcccagcacctcctgtttagcccactggattcaagcccactgcagttgctgctgcaccctcacggcaagagatgcaacccttgctgcagactgacctggatgagcagagagtgggaaaagcggaagcagatcctcggcggaggcggcaagtacaaagagtacttcctgaagcggattctcatccggaaggctatgacagtgctggccggcgataagaaaggcctgggaagattcatgagatgcgtgcagagcgagacaaaggccgtgtctctgcagctgcctctcggccgaagaaagtccggcgtgatgaagtgttgggatctgtgccccagactggactttcaccccagatctagctctggcggcgagaagctgaagcactgtttcaaagcctggggcctgtgcttcttctacctgctgtacttcgagaagaaacggcccgagtggctgagcgttgaccctcctggatctgtctggattctgccctgcatggacctggacggaatgctgacagtgatcggccagggactcgtgggcatgacccctagagatctgggaacagtggctggcgccaccgcacagattcagaggcctatccaggtgcagacaggcggcagactgttcctgattcacctgagaaaggtggacacccaccatctgcaggtcgtgaccaagaccgtgacagccacaacagctgacggccagaggatgcggagactgaagtgcaaggcctgtcggctgagatgggccagacctgaacctgctgcacaggctcctccaaagagccactttccacctcatcctagcggcccctccagaacctctagcctgcagctcagacccattcctccacacctgagacacccactgctgctgaagggaaagaacagcccctgctgccaaaagaaactgcgggtgcagaaccagggccatctgctgatgatcctgctgcataacgccagacagcccagcaggcctaccggaagaacccctaccacaagactgatggcccctgtgggcagcgtgatgtcttgtagcctgctgacccagccatctcctgccagcgcatgtacaatgccaccactcctgcatccacagtgggccccacatagtgctggactgtctccaggcgcttgcagacctgcctgtacctgcatcagcatgaccaccatctccagagccacatggcggctgagaatcccaagcctgaggaagtaccggcagaacatcgagatcacccctcagcggtctaaggcccaggtttccgtgtacagcggcaatctgctgagcttctccagacggggcatgaagagtagcgtgcggctgaagaacagcatccctcacgtgccaaaagccaccgccgctcactctgtgacagtgaagctgcagtacctgtttttcctgaccgtgtgcggcttcgaccgggtgttcctggttaagatctgcaagaagaagctgctcctcaagctgctgagaggccccagacggaaagtgctgatggtgctttggctgcccgccaaccagagtctgcagaaaagccaggtgttccagtgggtgctgcggaccgaaacctacatggaaatgcactacggccatcaggcccctcaggtggccatgctgcctaaactgctgtgtagacagatgctccccactctgtccacactccagcagaggcatcctcagggaccttgtcctcctcctgtgacacctctgagagtgcagtctgtgctgctcctgggagtgcctcagacagccgcttttagcggccggattctgcaccagccagaaatggccgccatgagactgatgcccaagttcctgaactccaccaacagctggtggacagtggcccctagatgtcctagaagcgccgtggacattagccccggacctacatctcctagcctggcctcttgtgcctctgtggccattggaaaactggcactgctgggcgcatctgccccttgtggcgcagctggtgctagagaggctggaagatttgccgtgctgggcaccatggttatgaagggtgctgccgcagcctcctgtcagtctcctccatctccaagagagacaacccctagcagcgacgccaccagacggacaagacctattgccgctcagagcaaaaagaccatgactgccgccggactgacccctcggagaaacctgcagagaaatctgaaggtcctgggcgccaagaagatcaccttcctgagaaacagcagacgcgccacacctacctctaagggcagcctgagaagaaagtacctgagagtgaacatccgcaagctcatctggaccaagcagcggagcttcctgtctctgttccccaagctgagagccaccgagcagatgaccaatgtgggatgcctgctcaagaaaagcagccaattgcggcggagctggcgcaatgtgtcccggatcagcaacatggaacacaggctgaccatggacagcgccctgagcctgacaaagagagagggccctgagacaagcgagaagaagaggaagttgcct

SEQ ID NO: 1170 - DNA, 4521 bp, Artificial Sequence
  polynucleotide 4D
aacagaaagaccagaaaggccgccagagagaagcaccgcaagaccgacgacaagaagaagaagtccaccgaaaagaccaagaacgccaagaagatgcccttccagcagcggcctcctctgcagcctgttaacctggatctgcagcaccagcgcagacgcaaaaagaagaaagacaaggtcgaaatccggaatcggagccctaaggccaatagcaccgagtgtcagggcgagcacagcagagagcagaacctgctgaatctggtgcagctgaaccctcacagccctcaccacagaaaggacgaagaggaccaccagaagcggcaccaccaccacaatcaaaagaaaatgagcgtgcgggctagcgtgtccttctggacacttttgccaacaaccggcgtgcggacaagaggctctccactgagactgacactgtggcctccacgggttccaccttctccacctcttgctctgggccccagaatgcagctgtgtacccagctcgcccggttcttccctatcacacctcctgtgtggcacatcctgggacctcagagacacacacctcaggctcctctgaggctgtggtcttggtgcggcacaagccagacctacttcggcagcagaccatctccttgcctgagctggtccagcagaattgtggcccctggacacgccctgagctgtcggactagaagaagatggtctagcaagcggtggatcttctccaaccagctgaccgtgcagatgctgtgcctgccaatcacacacccattcgcctctcagcctctgggacaagagatgcccaacaacacccagatccggctgctgaagccctgcagagtgaacgccgtggaagaactgcacagcaggcggatgtctgtgcggatcgtgaagaactgggtgtcctgctgttacgtgcggctgtctgctgtgggcctgtctacttggagtgccctggacgaggaaaagaagaacggccggatcagcagcctgaaaaagaaagtgaatgcctgcagctccctgatcctgagcttccagcgcgtgaaaaccggcatggaaatcctgctgtggattctgctgaagatggaaattcagatcttcaagatttgcctgggcgagatgcagctctgcggccaggcctttggaagctttagcgccgatttcagcgcccctcagatcattaagaagatgaagaaacggatcatggtgcacgagctgaagaagaatctgctgctgcctatgtgctccagcctggctctgccaacaggcctgacatctctgatcctgcctagcagcgatctggccgtgctgatctctagctccaccagccactttctgatgcggagccctgtgctgccaagcagcagactgacttgtgcctctccacagctgccccggatgtggacttggtctagctggctgaagaacgagggcaacaaccactggcctagagtggaaatgcctaccggctggctgctcgtcggctacaacaccagaaacacagcccagaatcctcggctgcagcagcacctgaaacactggcagcagtgcaccagagccagatggtgtcaagagccctgtcagaccctgaccttcttccatttcttcttctttttcaaaacggtgtccctgtgttgccccggctggtctaaaggacaacctcctccacctggcctgaagccttctagcctggcttctcaggtggccagaaccacaggcgtgtaccagcacgtgtggctgatctgtttcgtgtttttcgtgtgtgtggaaaccggcttctgtcacgtggcccaagtgggactcgagagactggtgtctctgtccggcatcaccgacgtgaaccattgggcccagcctaagccatctcctagcaaaggcaccggcatgaacagacccatcggcctgagagttggcaaaggcgtgtgggccagactgatcctggccatgacactgaccctgaacggcatggccaagaagtcccagcagcctctgcaggtcgtgctgagactgggaaacctgcctccattcttcagaggcagcgaggtgccctttcctagaccttgtcggaccaagcctgcctgcacaagcaaggcctggactcccagaaaactcgtggggagagccgtgcggagaaagggatctccactctgggattgctccaccacaacaggcacacaccacggatgcctgtgggagatcccatctgtgaccctgctggcccatcctagaaccgcctctatcaccctgcctaccacaagcctgaagggctccagaaccagctgctgccctagatctcaccccagactgcctaggaccaaatggcccctgcagtgtctgctgcacagcctgggaacaaccggaacactcgtttgggaaaggggcgtcctgcagatgagatccctcgaagcccattgtccactgcagaccttccatctgcaccactgcaggacccagcctagctcttgtcctcctgcctggattctgtaccaaggacagtggagcggagccgtcgtgggacttagacctgtggctcaccatctgcctagacctatccagggcctgcactgtccacaggcacctcatcaacctgctctgagctggggaaaatggcccgtgggaatgacaggccctgccagatgttgcagatggcccagacggtgccagaagaaggttccatcagcctctccatggggcctcgtgctcaaaaagaaccggaaacagatgctgaaccagaagtgtctggccccttttagagagagcaccctgggcaatttctggatgaagctgctccagctgcctgtcgtgatcaacctgaagagactgcagaagttcaacctgcacctgtgctactaccacagccagagcaacagaaacaagagccgccagatggaatccctgggcatgaagttgcagtcccagaaatcccagcaccactgtgccctgcggaagatcgagtgggccacaaagttgtctctcggcggaaaagccggaccacaggctcaagagaaggccacctctcggattctgaacctgcaagtgctcaagaagatcctgcggagctttatgaagctgtaccactctctggtcatgtgcctgcggctgaggaccaagctggaaaaggctctgagcgccctgttcatctggccccagcacagctacaagcccctgttctttcacggcgacctgtgcgagtggggaggccaggctcatagacagcggaactggctgaaaaactggaagcggttcaagcttaaaaagaagtacatccagaagaagaagcagaagtctaacaagatcatctgcaagggccaccgcatcaccatcatctgtatcaagaatatgttcctgcagcgcaagggcttcctgaacctgagccacgtggaaaagttctgtagaggcggccctagcgccagcgatagatgctgttcttgtagccccagcggcttcagtgccggcagaggaagatgtcctgttcagggctgtctgaggccccacagagttcaactgctgagaagatggggccctggctctcctgctggacagaggctgtctaagggctttcagctgctccgttggtggggaccaggatctcctgctcctgagcctagaaagggcccatttccaccacctgatcctccatggcctgtgaccgctgtgacagtgatggctggatctgtgcctagtgctcagtctgtggacgccctggaatctcctggacctctggctctcgaaggacctagcagccctagaaacctgctttggagagagatgagcatctttctgcccggcatcttcaccgccaagaaaagccccaccagcttttgctgcaatatcctgaacagcctgccaagctctatggaaatcgccgtgctgcaagaggacagcaaaaagatgacccagaagggccaagccttcggctccctgtgtcagcttgtgtccgctgacttctctgcccctcaagtgacccggctgcggagcctgaatcatctgctgatcacctacacaccccacatctgcagacacaccctgctgacccctgacaccagatggatctttagcaatcagctgcagacagtccagatgctctgtctgcctccactgaagcagggcgagagaatcatttggcccctcggcggctttcagatccccaacttcttttggagcctcggcatcggacacactggcgcctggtggcatactggaaggcggagaagagaatggggcggcagcaccgtgtctagaagccctctgtggatcagctccatgatctacctgagaggcatggccttcgccagcgacagcagcatcagaaccaccagagtgtcctggtgcagaagatgcggcgccaaaagcgctgccgccagctctattgaagctctgaccgctctgtttacctgccggaccgccagcatcagcgtgaacatcagcaccctgatgtccatcctggaagcacttaagaagaaacccagagacatctgccgcatcagctgccggtgtagacgcgagtacagagtgactatg

SEQ ID NO: 1171 - protein, 1547 aa, Artificial Sequence
  hTPA- and HA-extended poly-FSP polypeptide 1C
MDAMKRGLCCVLLLCGAVFVSPSQEIHARSTRREMPSQATPSPPGPWRAALGKEVKRSQSKLRLRNTSPTEIQLTMNDSKHKLESPALKQVSPASPPTQQPQTPQDSRQVLAASSPGHPLGPGDCPRTMAGPSASLHPASGRASRKTWQRRLRACRAGGPAGWARQAMTLKALVKTWTQFRNYPRVGAGTGGGPACVPVAEASTGAWTAEGAAGTRCRASRAPCRQLPASSPTKCEICVKRRRRRKRSSQSRSPVPKKRERMMLPVRARTARSALPQGRAPLEGMLLPRALPSLLSRMPARRESRFWLALQALGLRPPHLPSCHPLPQLLGPPPPHQAPFDKKGFVILSKGKKRRKEIRRMTRRTMTTTKMMMMRRTKRRRRKRRRMTMMTRRTLLTKKTCLTPRTSAATKALPRQTISQRRPIQTPPGTSLAIWGRLPLRPQRGPRPLHRWLQQTTGCSQRRIAKKRIKLRRNTLAIRFISAPQPSSSTVTAAPSGQYFSSFFYTSDRTKCEICVKNTAILAITLITPQDPHLDPVCHPHRRPGWKGHHRVVFSHHPSGSTKSHWQQRERGGGRREKKGCREMPSSWSSSGRTADKKNVRSRTRLTLTGTRSSGTRASPSAVCLCCWTCPSRSFPAASPSGLRAPVGAQAPPEVTLRASCASSASKACAGLWPWGAQVRNKVRQNFKRNLAKKTLTNALRSMPKSRNQVLFRRNLTPSQLRTLAPPYMLLPQSLSQSLSRKQIPSQSMLVTAFFLLDIILRSLLYSRMCLVQIPTHTWEPDYFVSLPMMFSWATQSFPVGAVFLTRPAIPCCSCTSHSNPWSQSFKKKKPLTFSPSVPMSLACSITVSFVGQISTLVLDVSSISHWRKRKREKRSQKSRQNHLQLKSCRRKISNWSKLRSPWIFYPRLKTFGVPLGSILCLAGSLSTMMIISTTRQECGRRASVPCRPMIGSARPGPWRTSAMPSAMGVALPTSCESGRSPPATGGRMPGSQSIMMSWMPPLAPCAACPCSPAPTLCPAHPARAPTAVPAFTPLSAHPVPVLSGCHLAVRTSMLTLLPMRHPHRSPPTSCPPLLEAFPLPRASLRATVPRHSSVLATGLHLHRQISLPLRGFLLHQPLPGQHLWLSHRLRLRLPRTGEKNDLQLFVMSDTTYKIYWTVILLNPCGNLHLKTTSLRRARPTSCSTCRMWWLKLAPLQVTTTLKLILVMLEIVTEEAKKSMKRSRRSKIEASPIGSIMKKKDSTIFINQQLKWTPHILKSASVSKKRLPKLNGIWEVMPRTLEGCISVKDHRTSQNHSKCITECVRTALNQRKVVKNPSQPVPLRNDGITNGNDSTRSCSISLKKSLEKMPLMNAKKMEDMIWESNMGGNRSICLTRLPCKVTESSQRPPRSILSLASRAGQFPVWRRTSRGMSLQWKSGNACTPLRCPSRSPATFLTALNGWHRSGLRAQQPSLPGPCASLLSTLSQPPPQAPSQVWTAATLRCPAVPAAACPPIVFFLAPYFPTPLSISRPTSRARQSCCLPGLTHPAHQPLGSMGYPYDVPDYAS

SEQ ID NO: 1172 - protein, 1541 aa, Artificial Sequence
  hTPA- and HA-extended poly-FSP polypeptide 2C
MDAMKRGLCCVLLLCGAVFVSPSQEIHARRQINRRKLQRKKRRKKREDHCGLRARNRNMKKTMSHLIAHQALKMSGLRLFHPRLLTRKKPGKNPRRKTWKMRKKYAQKPSQKNHLYGKGLTHPVPLKRTLQNKRNKNIKRVNQKKGNIKRKSILLHLIVLNSPESNLQAHPQVPALAPQAWWPARRGPLTSAPSAQQSLTFLPSRFPWGPPPLHWNSAYLGRTLLVTCILYHRWIVTSMCQSQRWLTSTTSRSSALMWTQWSSVTSLEWTAQERGCSSWLMKQTWMKSWSLRDPSYRSILEYVSTRVLWMPTSTVGALRATAPATAAPQAQTPHWRAATTSSMSSSPRAEPTSSSSWATCWPRCCSSSCYWSLSSWPPAGAAEATNTRTRSRESQRGRMLTWRSSLWLQGTRCFTGVRTSSRHPSWPWTRCLRMRPPRSNSRKKLLEDMKQNGFTRYKKRGVIAWRRATFLLALWECSLPQARLCLIVSRTLLLVQSRCSLMEQIPHLKSWWCTRGGGKRKKKMCKVSGGCTACVERCPWKGICWKWPVTVAALILIQHGGIFTFRFWVEKLSWNICKNLSLYLDKFVQRLLYVYIIETNVFVLNLFHVPVNQIFMMAFYLKYTEKAWVMELEWLIQQQCYQLLLAHMYGFSTYGTQKGECVCLQCLSGSSLFILKQPLDLKISKTFMSRSHLDFSPYWMKKVKASPQIMQRMSAVNFETIRRKWQIRHVLKNLPLENTQIPRTSPLWKITMVLTYPNCVVHVLMFVLFKADQSESSLSSGIYPPSTCSLPCRGIRMCALSHPSFYISSTVCFLSKHCMTACTREKIINPTISCPFQSPTKRLGHREGSESDNLGLLYSFPPWLPMRSLGEPWRAGFQWGESPWQVMASLTGNSVIVHKIVLVFLKSLSSYNCERRISGIQKRAIEFAVLKLLNMDLASPQIMQRTSADRFRMKRRMQNLDNLGVPWPLLPGAAPPHRLLGPSRWILFHVRNIVYGIQVMLCRRRNSRKQSQVQLAIQVLLVDKHKYFLFGPYPISEGLTMTTGRNINSNSLMTNCLFSPIFLCHHAIMHRKMTSPHFRLFSSKIPHPQVPSVVALCKFLANGLWFNLIFQKKGHMIFSPKFFLTFSQRTLESAGLFPWLHTQCRNKKTKLWFSLINIHHRKNPLLPMRMSRTPPRRVCGSPPLHLCQPLRGGKKRSKFAFWKPPSQGISSCLMTGCWGSCGRACSCGRGCGTPRGDWKRHPPRRELSLEPWIPYLHQQKTQRKRMKTGAIQEKGAIQEKGAMTKRICVVNFEACREMESLSAPEKITLFEAHMARCTSINVLCVRASLIEKLMKEKRKMKRNQVASPQIMQRLFIKGYQNNHFTFHLQNFAFFSSFGNNKYINILTRAFIHTPRSPGCSVYANMCWRKMQSLNHPSRLTNCHPAWLSPISACPRLLPYPFHVLALEVTFPPGTAMPQMQLQALAMWEKGWDKQEKKSRKLMSSCLEKKATWMRRTPGTSLQCYLNTHPCTMLLPQGIPSLNAQWMFLRIGYPYDVPDYAS

SEQ ID NO: 1173 - protein, 1546 aa, Artificial Sequence
  hTPA- and HA-extended poly-FSP polypeptide 3C
MDAMKRGLCCVLLLCGAVFVSPSQEIHARPIPPHLRHPLLLKNKKRRKLRPKSRKKGHTKNRRKAKRKPQIRNSRRATPTSKGSLRRKYLRVGAAAASCQSPPSPRETTPSSDATRRTRPIAAQSKKTMTAAGLTPSQKKDPAGKLKKQVSVYSGNLLSFSRRGMKSSVRLKNCTNLSVPMMLTILIWKRVFILLLSDKKSIPHVPKATAAHSVTVKLQSRRNRRYRKIYGELKMSLQASNGMEACGTHPTPRLSVSVITMKLWEKHFKGLNWNLVVWILNLKMMLKKKYLVQREWEKRKQILGGGGKYKEYFLKRILIRKAMTVLAGDKKGLGRFMRCVQSETKAVSLQLPLGRMDLDGMLTVIGQGLVGMTPRDLGTVAGATAQIQRPIQVQTGGRLRGPRRKVLMVLWLPANQSLQKSQVFQWVLRTELPLTFSTLLWDSRHDLPRMLPISSPLHRPQMPFWTCTFPATTWGTWETPSTWGWRTFARQPSRPTGRTPTTRLMAPVGSVMSCSLLTQPSPASACTMPPLLHPQWAPHSAGLSPGACRPACTCISMTTISRATWRRNLQRNLKVLRLRIPSLRKYRQQNTRSTNLEKNPSLKKQSQRRGKLSLTTLSFVLIEELLKKSSQLRRSWRNVSRISNIRKLIWTKQRSFLSLFPKLRATEQMTNVGCRLDFHPRSSSGDRVFLVKIQSSPFLARSWNTMQWNNKKMAMTVIAGAHHCQYKLTYTKVWKMNWKKMMIGSQHLLFSPLDSSPLQLLLHPHGKRCNPCCRLTWMSHLNRKLHLTRSCLIDLTMMMSQKLWKNQRKRIPLPSPRQHLLPQYPLHPPPPCLLLLHHRHHLAFLEMACSSQHTHSIKIWISFSHETMSLSNILMKFRLTTTTSSPRRSPALRARGGTTIGEVTSSLFFSHCLCVAPRCPRSAVDISPGPTSPSLASCASVAIGKLALLGASAPCGAAGAREAGRFAVLGTMVMKNMEHRLTMDSALSLTKREGPETGPVYYVCNRMNVSSVLKPFLFTVPIEDMRECTLGRNRMNVSSVLKPCLIPVPICKKKLLLKLLRGASSSTSRDSRSFFTSAHPSRPCRMRLYQMLQKQCCYNLVIKHPLIFRINLRRQGKTKDGVVQSLGFLNQQIILQKEFFICLLMFIKRWKPAATKKGKNSPCCQKKLRVQNQGHLLMILLHNRGPPLHTRFEKKRPEWLSRKSGVMKCWDLCPAFSGRILHQPEMAAMRLMPKFLNSTNSWWTVHKKRGLFHQMKCLTAVDCLQAFWDMSEKKRKLPMIRKIQKRRRTANRNIEITPQRSKAHLKKTSAKGAKKITFLCLRVRCGGWLCGWTPRGWLKKSTKSRLCFFYLLYYLFFLTVCGFTPPPLILWPQAAPGEKLKHCFKAWGVDPPGSVWILPCFLIHLRKVDTHHLQVVTKTVTATTADGQRMRRLKCKACRLRWARPEPAAQAPPKSHFPPHPSGPSRTSSLQLRTYMEMHYGHQAPQVAMLPKLLCRQMLPTLSTLQQRHPQGPCPPPVTPLRVQSVLLLGVPQTAGYPYDVPDYAS

SEQ ID NO: 1174 - protein, 1547 aa, Artificial Sequence
  hTPA- and HA-extended poly-FSP polypeptide 4C
MDAMKRGLCCVLLLCGAVFVSPSQEIHARDSKKMTQKNRKTRKAAREKHRKTDNLDLQHQRRRKKKKDKVEIRNRSPKANSTECQGEHSREQNLLNLVQLNPHSPHHRKDEEDHQKRHHHHNQKKMSVNEGNNHWPRVEMPTGWLLVGYNTRNTAQNPRLQQHLKHWQQCTRARWCQEPCQTLTFFHFFFFFKTVSLCCPGWSKGQPPPPGLKPSSLASQVARTTGVYQHVWLICFVFFVCVETGFCHVAQVGLERLVSLSGITDVNHWAQPKPSPSKGTGMNRPIGLRVGKGVWARLWLKNWKRFKLKKKYTGMEILLWILLKMEIQIFKICLGEMQLCLKKKVNACSNAKKMPFQCRCRREYRVTMIQKKKQKSPLFFHGDLCRPSPCLSWSSRIVAPGHALSCRTRRRWSSKMAKKSQQPLCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIFNLHLCYYHSQSNRNKSRQMESLGMKLQITHPFASQPLGQEMPNNTQIRLLKPGQAFGSFSADFSAPQQAPLRLWSWCGTSQTYFGSIEALTALFTCRTASISVNISTLMSILEAILAMTLTLNGSPLWDCSTTTGTHHGCLWEIPSVTLLATAKKSPTSFCCQRPPLQPVEEKKNGRISSVPPSPPLALGPRMQLCTQLARFFPITPPVWHILGPQRHTPLLTPDTRWIFSNQLQTVQMLCLPPLKQGERIIWPLGGFQIPNFFWSLGIGHTGAWWHTGRRRREWGGSTVSRSPLWISSMIYLRGMAFASDSSIRTTRVSWCRRCGAKSAAASSDKKKKSTEKTKNKIICKGHRITQVVLRLGNLPPFFRGSEVPFPRPCRTKCQKKVPSASPWGLHPRTASITLPTTSLKGSRTSCCPRSHPRLPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRRMCSSLALPTGLTSLILPSSDLAVLISSSTSHFLMRSPVLPSSRLTCASPQLPRMWTWSSWLKEWGGQAHRQRNCRVNAVEELHSRRMSVRIVKNWVSCCYVRLSAVGLSTWSALDSLILSFQRVKTSRILNLQVLKKILRSFMKLYHSLVMCLRLRTKLEKALSALFIWPQHSYKGQAFGSLCQLVSADFSAPQVTRLRSLNHLLIRWIFSNQLTVQMLCLPIIKKMKKRIMVHVLKKNRKQIICIKNMFLQRKGFLNLSHVEKFRESTLGNFWMKLLQLPPACTSKAWTPRKLVGRAVRRKGVVINLKRLQKFRASVSFWTLLPTTGVRTRGSPLRLTLWPPRSQKSQHHCALRKIEWATKLSLGGKAGPQAQEKANILNSLPSSMEIAVLQEMLNQKCLAPFELKKNLLLPTYTPHICRHTLKKKPRDICRISGYPYDVPDYAS

SEQ ID NO: 1175 - protein, 1750 aa, Artificial Sequence
  hINV- and HA-extended poly-FSP polypeptide 1C
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMSTRREMPSQATPSPPGPWRAALGKEVKRSQSKLRLRNTSPTEIQLTMNDSKHKLESPALKQVSPASPPTQQPQTPQDSRQVLAASSPGHPLGPGDCPRTMAGPSASLHPASGRASRKTWQRRLRACRAGGPAGWARQAMTLKALVKTWTQFRNYPRVGAGTGGGPACVPVAEASTGAWTAEGAAGTRCRASRAPCRQLPASSPTKCEICVKRRRRRKRSSQSRSPVPKKRERMMLPVRARTARSALPQGRAPLEGMLLPRALPSLLSRMPARRESRFWLALQALGLRPPHLPSCHPLPQLLGPPPPHQAPFDKKGFVILSKGKKRRKEIRRMTRRTMTTTKMMMMRRTKRRRRKRRRMTMMTRRTLLTKKTCLTPRTSAATKALPRQTISQRRPIQTPPGTSLAIWGRLPLRPQRGPRPLHRWLQQTTGCSQRRIAKKRIKLRRNTLAIRFISAPQPSSSTVTAAPSGQYFSSFFYTSDRTKCEICVKNTAILAITLITPQDPHLDPVCHPHRRPGWKGHHRVVFSHHPSGSTKSHWQQRERGGGRREKKGCREMPSSWSSSGRTADKKNVRSRTRLTLTGTRSSGTRASPSAVCLCCWTCPSRSFPAASPSGLRAPVGAQAPPEVTLRASCASSASKACAGLWPWGAQVRNKVRQNFKRNLAKKTLTNALRSMPKSRNQVLFRRNLTPSQLRTLAPPYMLLPQSLSQSLSRKQIPSQSMLVTAFFLLDIILRSLLYSRMCLVQIPTHTWEPDYFVSLPMMFSWATQSFPVGAVFLTRPAIPCCSCTSHSNPWSQSFKKKKPLTFSPSVPMSLACSITVSFVGQISTLVLDVSSISHWRKRKREKRSQKSRQNHLQLKSCRRKISNWSKLRSPWIFYPRLKTFGVPLGSILCLAGSLSTMMIISTTRQECGRRASVPCRPMIGSARPGPWRTSAMPSAMGVALPTSCESGRSPPATGGRMPGSQSIMMSWMPPLAPCAACPCSPAPTLCPAHPARAPTAVPAFTPLSAHPVPVLSGCHLAVRTSMLTLLPMRHPHRSPPTSCPPLLEAFPLPRASLRATVPRHSSVLATGLHLHRQISLPLRGFLLHQPLPGQHLWLSHRLRLRLPRTGEKNDLQLFVMSDTTYKIYWTVILLNPCGNLHLKTTSLRRARPTSCSTCRMWWLKLAPLQVTTTLKLILVMLEIVTEEAKKSMKRSRRSKIEASPIGSIMKKKDSTIFINQQLKWTPHILKSASVSKKRLPKLNGIWEVMPRTLEGCISVKDHRTSQNHSKCITECVRTALNQRKVVKNPSQPVPLRNDGITNGNDSTRSCSISLKKSLEKMPLMNAKKMEDMIWESNMGGNRSICLTRLPCKVTESSQRPPRSILSLASRAGQFPVWRRTSRGMSLQWKSGNACTPLRCPSRSPATFLTALNGWHRSGLRAQQPSLPGPCASLLSTLSQPPPQAPSQVWTAATLRCPAVPAAACPPIVFFLAPYFPTPLSISRPTSRARQSCCLPGLTHPAHQPLGSMGYPYDVPDYAS

SEQ ID NO: 1176 - protein, 1744 aa, Artificial Sequence
  hINV- and HA-extended poly-FSP polypeptide 2C
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMRQINRRKLQRKKRRKKREDHCGLRARNRNMKKTMSHLIAHQALKMSGLRLFHPRLLTRKKPGKNPRRKTWKMRKKYAQKPSQKNHLYGKGLTHPVPLKRTLQNKRNKNIKRVNQKKGNIKRKSILLHLIVLNSPESNLQAHPQVPALAPQAWWPARRGPLTSAPSAQQSLTFLPSRFPWGPPPLHWNSAYLGRTLLVTCILYHRWIVTSMCQSQRWLTSTTSRSSALMWTQWSSVTSLEWTAQERGCSSWLMKQTWMKSWSLRDPSYRSILEYVSTRVLWMPTSTVGALRATAPATAAPQAQTPHWRAATTSSMSSSPRAEPTSSSSWATCWPRCCSSSCYWSLSSWPPAGAAEATNTRTRSRESQRGRMLTWRSSLWLQGTRCFTGVRTSSRHPSWPWTRCLRMRPPRSNSRKKLLEDMKQNGFTRYKKRGVIAWRRATFLLALWECSLPQARLCLIVSRTLLLVQSRCSLMEQIPHLKSWWCTRGGGKRKKKMCKVSGGCTACVERCPWKGICWKWPVTVAALILIQHGGIFTFRFWVEKLSWNICKNLSLYLDKFVQRLLYVYIIETNVFVLNLFHVPVNQIFMMAFYLKYTEKAWVMELEWLIQQQCYQLLLAHMYGFSTYGTQKGECVCLQCLSGSSLFILKQPLDLKISKTFMSRSHLDFSPYWMKKVKASPQIMQRMSAVNFETIRRKWQIRHVLKNLPLENTQIPRTSPLWKITMVLTYPNCVVHVLMFVLFKADQSESSLSSGIYPPSTCSLPCRGIRMCALSHPSFYISSTVCFLSKHCMTACTREKIINPTISCPFQSPTKRLGHREGSESDNLGLLYSFPPWLPMRSLGEPWRAGFQWGESPWQVMASLTGNSVIVHKIVLVFLKSLSSYNCERRISGIQKRAIEFAVLKLLNMDLASPQIMQRTSADRFRMKRRMQNLDNLGVPWPLLPGAAPPHRLLGPSRWILFHVRNIVYGIQVMLCRRRNSRKQSQVQLAIQVLLVDKHKYFLFGPYPISEGLTMTTGRNINSNSLMTNCLFSPIFLCHHAIMHRKMTSPHFRLFSSKIPHPQVPSVVALCKFLANGLWFNLIFQKKGHMIFSPKFFLTFSQRTLESAGLFPWLHTQCRNKKTKLWFSLINIHHRKNPLLPMRMSRTPPRRVCGSPPLHLCQPLRGGKKRSKFAFWKPPSQGISSCLMTGCWGSCGRACSCGRGCGTPRGDWKRHPPRRELSLEPWIPYLHQQKTQRKRMKTGAIQEKGAIQEKGAMTKRICVVNFEACREMESLSAPEKITLFEAHMARCTSINVLCVRASLIEKLMKEKRKMKRNQVASPQIMQRLFIKGYQNNHFTFHLQNFAFFSSFGNNKYINILTRAFIHTPRSPGCSVYANMCWRKMQSLNHPSRLTNCHPAWLSPISACPRLLPYPFHVLALEVTFPPGTAMPQMQLQALAMWEKGWDKQEKKSRKLMSSCLEKKATWMRRTPGTSLQCYLNTHPCTMLLPQGIPSLNAQWMFLRIGYPYDVPDYAS

SEQ ID NO: 1177 - protein, 1749 aa, Artificial Sequence
  hINV- and HA-extended poly-FSP polypeptide 3C
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMPIPPHLRHPLLLKNKKRRKLRPKSRKKGHTKNRRKAKRKPQIRNSRRATPTSKGSLRRKYLRVGAAAASCQSPPSPRETTPSSDATRRTRPIAAQSKKTMTAAGLTPSQKKDPAGKLKKQVSVYSGNLLSFSRRGMKSSVRLKNCTNLSVPMMLTILIWKRVFILLLSDKKSIPHVPKATAAHSVTVKLQSRRNRRYRKIYGELKMSLQASNGMEACGTHPTPRLSVSVITMKLWEKHFKGLNWNLVVWILNLKMMLKKKYLVQREWEKRKQILGGGGKYKEYFLKRILIRKAMTVLAGDKKGLGRFMRCVQSETKAVSLQLPLGRMDLDGMLTVIGQGLVGMTPRDLGTVAGATAQIQRPIQVQTGGRLRGPRRKVLMVLWLPANQSLQKSQVFQWVLRTELPLTFSTLLWDSRHDLPRMLPISSPLHRPQMPFWTCTFPATTWGTWETPSTWGWRTFARQPSRPTGRTPTTRLMAPVGSVMSCSLLTQPSPASACTMPPLLHPQWAPHSAGLSPGACRPACTCISMTTISRATWRRNLQRNLKVLRLRIPSLRKYRQQNTRSTNLEKNPSLKKQSQRRGKLSLTTLSFVLIEELLKKSSQLRRSWRNVSRISNIRKLIWTKQRSFLSLFPKLRATEQMTNVGCRLDFHPRSSSGDRVFLVKIQSSPFLARSWNTMQWNNKKMAMTVIAGAHHCQYKLTYTKVWKMNWKKMMIGSQHLLFSPLDSSPLQLLLHPHGKRCNPCCRLTWMSHLNRKLHLTRSCLIDLTMMMSQKLWKNQRKRIPLPSPRQHLLPQYPLHPPPPCLLLLHHRHHLAFLEMACSSQHTHSIKIWISFSHETMSLSNILMKFRLTTTTSSPRRSPALRARGGTTIGEVTSSLFFSHCLCVAPRCPRSAVDISPGPTSPSLASCASVAIGKLALLGASAPCGAAGAREAGRFAVLGTMVMKNMEHRLTMDSALSLTKREGPETGPVYYVCNRMNVSSVLKPFLFTVPIEDMRECTLGRNRMNVSSVLKPCLIPVPICKKKLLLKLLRGASSSTSRDSRSFFTSAHPSRPCRMRLYQMLQKQCCYNLVIKHPLIFRINLRRQGKTKDGVVQSLGFLNQQIILQKEFFICLLMFIKRWKPAATKKGKNSPCCQKKLRVQNQGHLLMILLHNRGPPLHTRFEKKRPEWLSRKSGVMKCWDLCPAFSGRILHQPEMAAMRLMPKFLNSTNSWWTVHKKRGLFHQMKCLTAVDCLQAFWDMSEKKRKLPMIRKIQKRRRTANRNIEITPQRSKAHLKKTSAKGAKKITFLCLRVRCGGWLCGWTPRGWLKKSTKSRLCFFYLLYYLFFLTVCGFTPPPLILWPQAAPGEKLKHCFKAWGVDPPGSVWILPCFLIHLRKVDTHHLQVVTKTVTATTADGQRMRRLKCKACRLRWARPEPAAQAPPKSHFPPHPSGPSRTSSLQLRTYMEMHYGHQAPQVAMLPKLLCRQMLPTLSTLQQRHPQGPCPPPVTPLRVQSVLLLGVPQTAGYPYDVPDYAS

SEQ ID NO: 1178 - protein, 1750 aa, Artificial Sequence
  hINV- and HA-extended poly-FSP polypeptide 4C
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMDSKKMTQKNRKTRKAAREKHRKTDNLDLQHQRRRKKKKDKVEIRNRSPKANSTECQGEHSREQNLLNLVQLNPHSPHHRKDEEDHQKRHHHHNQKKMSVNEGNNHWPRVEMPTGWLLVGYNTRNTAQNPRLQQHLKHWQQCTRARWCQEPCQTLTFFHFFFFFKTVSLCCPGWSKGQPPPPGLKPSSLASQVARTTGVYQHVWLICFVFFVCVETGFCHVAQVGLERLVSLSGITDVNHWAQPKPSPSKGTGMNRPIGLRVGKGVWARLWLKNWKRFKLKKKYTGMEILLWILLKMEIQIFKICLGEMQLCLKKKVNACSNAKKMPFQCRCRREYRVTMIQKKKQKSPLFFHGDLCRPSPCLSWSSRIVAPGHALSCRTRRRWSSKMAKKSQQPLCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIFNLHLCYYHSQSNRNKSRQMESLGMKLQITHPFASQPLGQEMPNNTQIRLLKPGQAFGSFSADFSAPQQAPLRLWSWCGTSQTYFGSIEALTALFTCRTASISVNISTLMSILEAILAMTLTLNGSPLWDCSTTTGTHHGCLWEIPSVTLLATAKKSPTSFCCQRPPLQPVEEKKNGRISSVPPSPPLALGPRMQLCTQLARFFPITPPVWHILGPQRHTPLLTPDTRWIFSNQLQTVQMLCLPPLKQGERIIWPLGGFQIPNFFWSLGIGHTGAWWHTGRRRREWGGSTVSRSPLWISSMIYLRGMAFASDSSIRTTRVSWCRRCGAKSAAASSDKKKKSTEKTKNKIICKGHRITQVVLRLGNLPPFFRGSEVPFPRPCRTKCQKKVPSASPWGLHPRTASITLPTTSLKGSRTSCCPRSHPRLPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRRMCSSLALPTGLTSLILPSSDLAVLISSSTSHFLMRSPVLPSSRLTCASPQLPRMWTWSSWLKEWGGQAHRQRNCRVNAVEELHSRRMSVRIVKNWVSCCYVRLSAVGLSTWSALDSLILSFQRVKTSRILNLQVLKKILRSFMKLYHSLVMCLRLRTKLEKALSALFIWPQHSYKGQAFGSLCQLVSADFSAPQVTRLRSLNHLLIRWIFSNQLTVQMLCLPIIKKMKKRIMVHVLKKNRKQIICIKNMFLQRKGFLNLSHVEKFRESTLGNFWMKLLQLPPACTSKAWTPRKLVGRAVRRKGVVINLKRLQKFRASVSFWTLLPTTGVRTRGSPLRLTLWPPRSQKSQHHCALRKIEWATKLSLGGKAGPQAQEKANILNSLPSSMEIAVLQEMLNQKCLAPFELKKNLLLPTYTPHICRHTLKKKPRDICRISGYPYDVPDYAS

SEQ ID NO: 1179 - protein, 1547 aa, Artificial Sequence
  hTPA- and HA-extended poly-FSP polypeptide 1D
MDAMKRGLCCVLLLCGAVFVSPSQEIHARADKKNVRSASSPGHPLGPRRMTRRTMTTTKMMMMRRTKRRRRKRRRMTMMTRRTLLTKKTCLTPRTSAATKALPRQTISQRRPIQTPPGTSLAIWGRRSKIEASPIGSITPLSISRPTSRARQSCCLPGLTHPAHQPLGSMVGAGTGGGPACVPVAEASTGAWTAEGAAGTRCRASRAPCRQLPASSPTKCEICVKRRRRRKRSSQSRSPVPKKRERMMLPVRARTARSALPQGRAPLEGMLLPRALPSLLSRMPARRESRFWLALQALGLRPPHLPSCHPLPQLLGPPPPHQAPGEKNDLQLFVMSDTTYKIYWTVILLNPCGNLHLKTTSLNAKKMEDMIWESNQQLKWTPHILKSASIAKKRIKLRRNSTRREMPSQATPSPPGPWRAALGKEVKRSQSKLRLRNTSPFDKKGFVILSNMGGNRSICLTIVFFLAPYFPMPSSWSSSGRTRLPLRPQRGPRPLHRWLQQTTGCSQRRGDCPRTMAGPSASLHPASGRASRKTWQRRLRACRAGGPAGWARQARKRKREKRSQKSRQNHLQLKSCRRKISNWSKLRSPWIFEAKKSMKRSQRPPRSILSLFKKKKPLTFSPSVSKKRLPKLKGKKRRKEIQRKVVKNPSQPVPLRNDGITNGNDSTRSCSISLKKSLEKMPLMRSLLYSRMCLVQIPTHTWEPDYFVSLPMMFSWATQSFPVGAVFLTRPAIPCCSCTSHSNPWSQSTLAIRFISAPQPSSSTVTAAPSGQYFALRSMPKSRNQVLFRRNLTPSQLRTLAPPYMLLPQSLSQSLSRKQIPSQSMLVRTRLTLTGTRSSGTRASPSAVCLCCWTCPSRSFPAASPSGLRAPVGAQAPPEVTLRASCASSASKACAGLWPWGAQVRMKKKDSTIFIYPRLKTFGVPLGSILCLAGSLSTMMIISTTRQECGRRASVPCRPMIGSARPGPWRTSAMPSAMGVALPTSCESGRSPPATGGRMPGSQSIMMSWMPPLAPCAACPCSPAPTLCPAHPARAPTAVPAFTPLSAHPVPVLSGCHLAVRTSMLTLLPMMTLKALVKTWTQFRNYPRRHPHRSPPTSCPPLLEAFPLPRASLRATVPRHSSVLATGLHLHRQISLPLRGFLLHQPLPGQHLWLSHRLRLRLPRTTEIQLTMNDSKHKLESPALKQVSPASPPTQQPQTPQDSRQVLAVPMSLACSITVSFVGQISTLVLDVSSISHWNGIWEVMPRTLEGCISVKDHRTSQNHSKCITECVRTALNTKCEICVKNTAILAITLITPQDPHLDPVCHPHRRPGWKGHHRVVFSHHPSGSTKSHWQQRERGGGRREKKGCREASRAGQFPVWRRTSRGMSLQWKSGNACTPLRCPSRSPATFLTALNGWHRSGLRAQTAFFLLDIILRRARPTSCSTCRMWWRLPCKVTESSLAKKTLTNQPSLPGPCASLLSTLSQPPPQAPSQVWTAATLRCPAVPAAACPPLKLAPLQVTTTLKLILVMLEIVTENKVRQNFKRNSSFFYTSDRGYPYDVPDYAS

SEQ ID NO: 1180 - protein, 1541 aa, Artificial Sequence
  hTPA- and HA-extended poly-FSP polypeptide 2D
MDAMKRGLCCVLLLCGAVFVSPSQEIHARRKMQSLNHPSRLTNNPRRKTWKMRKKYAQKPSQKNHLYRQINRRKLQRKKSRSHLDFSPYWMKKVKRARNRNMKKTMSHLIAHQALKMSGLRLFHPRLLTRKKPGKQKKGHMIFSRRKWQIRHVLKNLIPSLNAQWMFLRIASPQIMQRTSADRFRMKRRMQNLDNLGVPWPLLPGLLLAHMYGFSTYGTQKGECVCLQCLSGSSLFILKQPLDLKISKTFMASPQIMQRMSAVNFETILQAHPQVPALAPQAWWPARRGPLTSAPSAQQSLTRTLESAGLFPWLHTQCRAFIHTPRSPGCSVYANMCWRYKKRGVIAWRIYPPSTCSLPCRGLILIQHGGIFTFRFWVEKLSWNICKNLSLYLDKFVQRLLYVYIIETNVFVLNLFHVPVNQIFMMAFYLKYTEKAWVMELEWLIQQQCYQRKRMKTGAIQEKGAIQEKGAMTKRICVVNFEACREMESLSAPEKITLFEAHMARCTSINVLCVRASLIEKLMKEKRKMKRNQVASPQIMQRLFIKGYQNNHFTFHLQNFAFFSSFGNNKYINILTFLPSRFPWGPPPLGALRATAPATAAPQAQTPHWRAATTSSMSSSPRAEPTSSSSWATCWPRCCSSSCYWSLSSWPPAGAAEATNTRTRSRESQRGRMLTWRSSLWLQGTRCFTGVRTSSRCSLMEQIPHLKSNSRKKLLEDMKQNGFTRRRNSRKQSQVQLAIQVLLVDKHKYFLFGRATFLLALWECSLPQARLCLIVSRTLLLVQSRHPSWPWTRCLRMRPPRSHWNSAYLGRTLLVTCILYHRWIVTSMCQSQRWLTSTTSRSSALMWTWWCTRGGGKRKKKMCKVSGGCTACVERCPWKGICWKWPVTVAAMSRTPPRRVCGHREGSESDNLGLLYSFPPVLFKADQSESSLSSGNSVIVHKIVLVFLKSLSSYNCERRISGIQKRAIEFAVLKLLNMDLGKGLTHPVPLKRTLQNKRNKNIKRVNQKKGNIKRKSILLHLIVLNSPESNREKIINPTISCPFQSPTKRLGSPPLHLCQPLRPYPISEGLTMTTGRNINSNSLMTNCLFSPIFLCHHAIMHRKMTSPHFRLFSSKIPHPQVPSVVALCKFTHPCTMLLPQGAFWKPPSQGISSCLMTGCWQWSSVTSLEWTAQERGCSSWLMKQTWMKSWSLRDPSYRSILEYVSTRVLWMPTSTVPKFFLTFSQIRMCALSHPSFYISSTVCFLSKHCMTACTPGTSLQCYLNLANGLWFNLIFRNKKTKLWFSLINIHHRKNPLLPMRLEKKATWMRRTELSLEPWIPYLHQQKTQWLPMRSLGEPWRAGFQWGESPWQVMASLTGRRKKREDHCGLQEKKSRKLMSSCAAPPHRLLGPSRWGSCGRACSCGRGCGTPRGDWKRHPPRRILFHVRNIVYGIQVMLCCHPAWLSPISACPRLLPYPFHVLALEVTFPPGTAMPQMQLQALAMWEKGWDKPLENTQIPRTSPLWKITMVLTYPNCVVHVLMFGGKKRSKFGYPYDVPDYAS

SEQ ID NO: 1181 - protein, 1546 aa, Artificial Sequence
  hTPA- and HA-extended poly-FSP polypeptide 3D
MDAMKRGLCCVLLLCGAVFVSPSQEIHARQNTRSTNLEKNPSLKKQSQRRGKLSSRKKGHTKNRRKAKRKPQISQKKDPAGKLKKHLNRKLHLTRSCLIDLTMMMSQKLWKNQRKRIPLPSPRQHLLPQYPLHPPPPCLLLLHHRHHLAFLEMACSSQHTHSIKIWISFSHEDLPRMLPISSPLHRPQMPFWTCTFPATTWGTWETPSTWGWRTFGPVYYVCNRMNVSSVLKPFLFTVPIEDMRECTLGRNRMNVSSVLKPCLIPVPILTTLSFVLIEESRRNRRYRKIYGELKMSLQALPLTFSTLLWDSRHTTTTSSPRRSPALRARGGTTIGEVTSRGASSSTSRDSRSFFTSAHPSRPCRMRLYQSNGMEACGTHPTPRLSRGPPLHTRTMSLSNILMKFRLMLQKQCCYNLVIKHPLIFRINLRRQGKTKDGVVQSLGFLNQQIILQKEFFICLLMFIKRWKPAATKTPPPLILWPQAAPVHKKRGLFSLFFSHCLCHQMKCLTAVDCLQAFWDMMIRKIQKRRRTANRLKKKYLVQCTNLSVPMMLTILIWKRVFILLLSDKKCLRVRCGGWLCGWTPRGKNKKRRKLRPKHLKKTSAKVSVITMKLWEKHFKGLNWNLVVWILNLKMMWLKKSTKSRQSSPFLARSWNTMQWNNKKMAMTVIAGAHHCQYKLTYTKVWKMNWKKMMIGSQHLLFSPLDSSPLQLLLHPHGKRCNPCCRLTWMSREWEKRKQILGGGGKYKEYFLKRILIRKAMTVLAGDKKGLGRFMRCVQSETKAVSLQLPLGRRKSGVMKCWDLCPRLDFHPRSSSGGEKLKHCFKAWGLCFFYLLYFEKKRPEWLSVDPPGSVWILPCMDLDGMLTVIGQGLVGMTPRDLGTVAGATAQIQRPIQVQTGGRLFLIHLRKVDTHHLQVVTKTVTATTADGQRMRRLKCKACRLRWARPEPAAQAPPKSHFPPHPSGPSRTSSLQLRPIPPHLRHPLLLKGKNSPCCQKKLRVQNQGHLLMILLHNARQPSRPTGRTPTTRLMAPVGSVMSCSLLTQPSPASACTMPPLLHPQWAPHSAGLSPGACRPACTCISMTTISRATWRLRIPSLRKYRQNIEITPQRSKAQVSVYSGNLLSFSRRGMKSSVRLKNSIPHVPKATAAHSVTVKLQYLFFLTVCGFDRVFLVKICKKKLLLKLLRGPRRKVLMVLWLPANQSLQKSQVFQWVLRTETYMEMHYGHQAPQVAMLPKLLCRQMLPTLSTLQQRHPQGPCPPPVTPLRVQSVLLLGVPQTAAFSGRILHQPEMAAMRLMPKFLNSTNSWWTVAPRCPRSAVDISPGPTSPSLASCASVAIGKLALLGASAPCGAAGAREAGRFAVLGTMVMKGAAAASCQSPPSPRETTPSSDATRRTRPIAAQSKKTMTAAGLTPRRNLQRNLKVLGAKKITFLRNSRRATPTSKGSLRRKYLRVNIRKLIWTKQRSFLSLFPKLRATEQMTNVGCLLKKSSQLRRSWRNVSRISNMEHRLTMDSALSLTKREGPETSEKKRKLPGYPYDVPDYAS

SEQ ID NO: 1182 - protein, 1547 aa, Artificial Sequence
  hTPA- and HA-extended poly-FSP polypeptide 4D
MDAMKRGLCCVLLLCGAVFVSPSQEIHARNRKTRKAAREKHRKTDDKKKKSTEKTKNAKKMPFQQRPPLQPVNLDLQHQRRRKKKKDKVEIRNRSPKANSTECQGEHSREQNLLNLVQLNPHSPHHRKDEEDHQKRHHHHNQKKMSVRASVSFWTLLPTTGVRTRGSPLRLTLWPPRVPPSPPLALGPRMQLCTQLARFFPITPPVWHILGPQRHTPQAPLRLWSWCGTSQTYFGSRPSPCLSWSSRIVAPGHALSCRTRRRWSSKRWIFSNQLTVQMLCLPITHPFASQPLGQEMPNNTQIRLLKPCRVNAVEELHSRRMSVRIVKNWVSCCYVRLSAVGLSTWSALDEEKKNGRISSLKKKVNACSSLILSFQRVKTGMEILLWILLKMEIQIFKICLGEMQLCGQAFGSFSADFSAPQIIKKMKKRIMVHELKKNLLLPMCSSLALPTGLTSLILPSSDLAVLISSSTSHFLMRSPVLPSSRLTCASPQLPRMWTWSSWLKNEGNNHWPRVEMPTGWLLVGYNTRNTAQNPRLQQHLKHWQQCTRARWCQEPCQTLTFFHFFFFFKTVSLCCPGWSKGQPPPPGLKPSSLASQVARTTGVYQHVWLICFVFFVCVETGFCHVAQVGLERLVSLSGITDVNHWAQPKPSPSKGTGMNRPIGLRVGKGVWARLILAMTLTLNGMAKKSQQPLQVVLRLGNLPPFFRGSEVPFPRPCRTKPACTSKAWTPRKLVGRAVRRKGSPLWDCSTTTGTHHGCLWEIPSVTLLAHPRTASITLPTTSLKGSRTSCCPRSHPRLPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRRCQKKVPSASPWGLVLKKNRKQMLNQKCLAPFRESTLGNFWMKLLQLPVVINLKRLQKFNLHLCYYHSQSNRNKSRQMESLGMKLQSQKSQHHCALRKIEWATKLSLGGKAGPQAQEKATSRILNLQVLKKILRSFMKLYHSLVMCLRLRTKLEKALSALFIWPQHSYKPLFFHGDLCEWGGQAHRQRNWLKNWKRFKLKKKYIQKKKQKSNKIICKGHRITIICIKNMFLQRKGFLNLSHVEKFCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIFTAKKSPTSFCCNILNSLPSSMEIAVLQEDSKKMTQKGQAFGSLCQLVSADFSAPQVTRLRSLNHLLITYTPHICRHTLLTPDTRWIFSNQLQTVQMLCLPPLKQGERIIWPLGGFQIPNFFWSLGIGHTGAWWHTGRRRREWGGSTVSRSPLWISSMIYLRGMAFASDSSIRTTRVSWCRRCGAKSAAASSIEALTALFTCRTASISVNISTLMSILEALKKKPRDICRISCRCRREYRVTMGYPYDVPDYAS

SEQ ID NO: 1183 - protein, 1750 aa, Artificial Sequence
  hINV- and HA-extended poly-FSP polypeptide 1D
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMADKKNVRSASSPGHPLGPRRMTRRTMTTTKMMMMRRTKRRRRKRRRMTMMTRRTLLTKKTCLTPRTSAATKALPRQTISQRRPIQTPPGTSLAIWGRRSKIEASPIGSITPLSISRPTSRARQSCCLPGLTHPAHQPLGSMVGAGTGGGPACVPVAEASTGAWTAEGAAGTRCRASRAPCRQLPASSPTKCEICVKRRRRRKRSSQSRSPVPKKRERMMLPVRARTARSALPQGRAPLEGMLLPRALPSLLSRMPARRESRFWLALQALGLRPPHLPSCHPLPQLLGPPPPHQAPGEKNDLQLFVMSDTTYKIYWTVILLNPCGNLHLKTTSLNAKKMEDMIWESNQQLKWTPHILKSASIAKKRIKLRRNSTRREMPSQATPSPPGPWRAALGKEVKRSQSKLRLRNTSPFDKKGFVILSNMGGNRSICLTIVFFLAPYFPMPSSWSSSGRTRLPLRPQRGPRPLHRWLQQTTGCSQRRGDCPRTMAGPSASLHPASGRASRKTWQRRLRACRAGGPAGWARQARKRKREKRSQKSRQNHLQLKSCRRKISNWSKLRSPWIFEAKKSMKRSQRPPRSILSLFKKKKPLTFSPSVSKKRLPKLKGKKRRKEIQRKVVKNPSQPVPLRNDGITNGNDSTRSCSISLKKSLEKMPLMRSLLYSRMCLVQIPTHTWEPDYFVSLPMMFSWATQSFPVGAVFLTRPAIPCCSCTSHSNPWSQSTLAIRFISAPQPSSSTVTAAPSGQYFALRSMPKSRNQVLFRRNLTPSQLRTLAPPYMLLPQSLSQSLSRKQIPSQSMLVRTRLTLTGTRSSGTRASPSAVCLCCWTCPSRSFPAASPSGLRAPVGAQAPPEVTLRASCASSASKACAGLWPWGAQVRMKKKDSTIFIYPRLKTFGVPLGSILCLAGSLSTMMIISTTRQECGRRASVPCRPMIGSARPGPWRTSAMPSAMGVALPTSCESGRSPPATGGRMPGSQSIMMSWMPPLAPCAACPCSPAPTLCPAHPARAPTAVPAFTPLSAHPVPVLSGCHLAVRTSMLTLLPMMTLKALVKTWTQFRNYPRRHPHRSPPTSCPPLLEAFPLPRASLRATVPRHSSVLATGLHLHRQISLPLRGFLLHQPLPGQHLWLSHRLRLRLPRTTEIQLTMNDSKHKLESPALKQVSPASPPTQQPQTPQDSRQVLAVPMSLACSITVSFVGQISTLVLDVSSISHWNGIWEVMPRTLEGCISVKDHRTSQNHSKCITECVRTALNTKCEICVKNTAILAITLITPQDPHLDPVCHPHRRPGWKGHHRVVFSHHPSGSTKSHWQQRERGGGRREKKGCREASRAGQFPVWRRTSRGMSLQWKSGNACTPLRCPSRSPATFLTALNGWHRSGLRAQTAFFLLDIILRRARPTSCSTCRMWWRLPCKVTESSLAKKTLTNQPSLPGPCASLLSTLSQPPPQAPSQVWTAATLRCPAVPAAACPPLKLAPLQVTTTLKLILVMLEIVTENKVRQNFKRNSSFFYTSDRGYPYDVPDYAS

SEQ ID NO: 1184 - protein, 1744 aa, Artificial Sequence
  hINV- and HA-extended poly-FSP polypeptide 2D
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMRKMQSLNHPSRLTNNPRRKTWKMRKKYAQKPSQKNHLYRQINRRKLQRKKSRSHLDFSPYWMKKVKRARNRNMKKTMSHLIAHQALKMSGLRLFHPRLLTRKKPGKQKKGHMIFSRRKWQIRHVLKNLIPSLNAQWMFLRIASPQIMQRTSADRFRMKRRMQNLDNLGVPWPLLPGLLLAHMYGFSTYGTQKGECVCLQCLSGSSLFILKQPLDLKISKTFMASPQIMQRMSAVNFETILQAHPQVPALAPQAWWPARRGPLTSAPSAQQSLTRTLESAGLFPWLHTQCRAFIHTPRSPGCSVYANMCWRYKKRGVIAWRIYPPSTCSLPCRGLILIQHGGIFTFRFWVEKLSWNICKNLSLYLDKFVQRLLYVYIIETNVFVLNLFHVPVNQIFMMAFYLKYTEKAWVMELEWLIQQQCYQRKRMKTGAIQEKGAIQEKGAMTKRICVVNFEACREMESLSAPEKITLFEAHMARCTSINVLCVRASLIEKLMKEKRKMKRNQVASPQIMQRLFIKGYQNNHFTFHLQNFAFFSSFGNNKYINILTFLPSRFPWGPPPLGALRATAPATAAPQAQTPHWRAATTSSMSSSPRAEPTSSSSWATCWPRCCSSSCYWSLSSWPPAGAAEATNTRTRSRESQRGRMLTWRSSLWLQGTRCFTGVRTSSRCSLMEQIPHLKSNSRKKLLEDMKQNGFTRRRNSRKQSQVQLAIQVLLVDKHKYFLFGRATFLLALWECSLPQARLCLIVSRTLLLVQSRHPSWPWTRCLRMRPPRSHWNSAYLGRTLLVTCILYHRWIVTSMCQSQRWLTSTTSRSSALMWTWWCTRGGGKRKKKMCKVSGGCTACVERCPWKGICWKWPVTVAAMSRTPPRRVCGHREGSESDNLGLLYSFPPVLFKADQSESSLSSGNSVIVHKIVLVFLKSLSSYNCERRISGIQKRAIEFAVLKLLNMDLGKGLTHPVPLKRTLQNKRNKNIKRVNQKKGNIKRKSILLHLIVLNSPESNREKIINPTISCPFQSPTKRLGSPPLHLCQPLRPYPISEGLTMTTGRNINSNSLMTNCLFSPIFLCHHAIMHRKMTSPHFRLFSSKIPHPQVPSVVALCKFTHPCTMLLPQGAFWKPPSQGISSCLMTGCWQWSSVTSLEWTAQERGCSSWLMKQTWMKSWSLRDPSYRSILEYVSTRVLWMPTSTVPKFFLTFSQIRMCALSHPSFYISSTVCFLSKHCMTACTPGTSLQCYLNLANGLWFNLIFRNKKTKLWFSLINIHHRKNPLLPMRLEKKATWMRRTELSLEPWIPYLHQQKTQWLPMRSLGEPWRAGFQWGESPWQVMASLTGRRKKREDHCGLQEKKSRKLMSSCAAPPHRLLGPSRWGSCGRACSCGRGCGTPRGDWKRHPPRRILFHVRNIVYGIQVMLCCHPAWLSPISACPRLLPYPFHVLALEVTFPPGTAMPQMQLQALAMWEKGWDKPLENTQIPRTSPLWKITMVLTYPNCVVHVLMFGGKKRSKFGYPYDVPDYAS

SEQ ID NO: 1185 - protein, 1749 aa, Artificial Sequence
  hINV- and HA-extended poly-FSP polypeptide 3D
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMQNTRSTNLEKNPSLKKQSQRRGKLSSRKKGHTKNRRKAKRKPQISQKKDPAGKLKKHLNRKLHLTRSCLIDLTMMMSQKLWKNQRKRIPLPSPRQHLLPQYPLHPPPPCLLLLHHRHHLAFLEMACSSQHTHSIKIWISFSHEDLPRMLPISSPLHRPQMPFWTCTFPATTWGTWETPSTWGWRTFGPVYYVCNRMNVSSVLKPFLFTVPIEDMRECTLGRNRMNVSSVLKPCLIPVPILTTLSFVLIEESRRNRRYRKIYGELKMSLQALPLTFSTLLWDSRHTTTTSSPRRSPALRARGGTTIGEVTSRGASSSTSRDSRSFFTSAHPSRPCRMRLYQSNGMEACGTHPTPRLSRGPPLHTRTMSLSNILMKFRLMLQKQCCYNLVIKHPLIFRINLRRQGKTKDGVVQSLGFLNQQIILQKEFFICLLMFIKRWKPAATKTPPPLILWPQAAPVHKKRGLFSLFFSHCLCHQMKCLTAVDCLQAFWDMMIRKIQKRRRTANRLKKKYLVQCTNLSVPMMLTILIWKRVFILLLSDKKCLRVRCGGWLCGWTPRGKNKKRRKLRPKHLKKTSAKVSVITMKLWEKHFKGLNWNLVVWILNLKMMWLKKSTKSRQSSPFLARSWNTMQWNNKKMAMTVIAGAHHCQYKLTYTKVWKMNWKKMMIGSQHLLFSPLDSSPLQLLLHPHGKRCNPCCRLTWMSREWEKRKQILGGGGKYKEYFLKRILIRKAMTVLAGDKKGLGRFMRCVQSETKAVSLQLPLGRRKSGVMKCWDLCPRLDFHPRSSSGGEKLKHCFKAWGLCFFYLLYFEKKRPEWLSVDPPGSVWILPCMDLDGMLTVIGQGLVGMTPRDLGTVAGATAQIQRPIQVQTGGRLFLIHLRKVDTHHLQVVTKTVTATTADGQRMRRLKCKACRLRWARPEPAAQAPPKSHFPPHPSGPSRTSSLQLRPIPPHLRHPLLLKGKNSPCCQKKLRVQNQGHLLMILLHNARQPSRPTGRTPTTRLMAPVGSVMSCSLLTQPSPASACTMPPLLHPQWAPHSAGLSPGACRPACTCISMTTISRATWRLRIPSLRKYRQNIEITPQRSKAQVSVYSGNLLSFSRRGMKSSVRLKNSIPHVPKATAAHSVTVKLQYLFFLTVCGFDRVFLVKICKKKLLLKLLRGPRRKVLMVLWLPANQSLQKSQVFQWVLRTETYMEMHYGHQAPQVAMLPKLLCRQMLPTLSTLQQRHPQGPCPPPVTPLRVQSVLLLGVPQTAAFSGRILHQPEMAAMRLMPKFLNSTNSWWTVAPRCPRSAVDISPGPTSPSLASCASVAIGKLALLGASAPCGAAGAREAGRFAVLGTMVMKGAAAASCQSPPSPRETTPSSDATRRTRPIAAQSKKTMTAAGLTPRRNLQRNLKVLGAKKITFLRNSRRATPTSKGSLRRKYLRVNIRKLIWTKQRSFLSLFPKLRATEQMTNVGCLLKKSSQLRRSWRNVSRISNMEHRLTMDSALSLTKREGPETSEKKRKLPGYPYDVPDYAS

SEQ ID NO: 1186 - protein, 1750 aa, Artificial Sequence
  hINV- and HA-extended poly-FSP polypeptide 4D
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPMNRKTRKAAREKHRKTDDKKKKSTEKTKNAKKMPFQQRPPLQPVNLDLQHQRRRKKKKDKVEIRNRSPKANSTECQGEHSREQNLLNLVQLNPHSPHHRKDEEDHQKRHHHHNQKKMSVRASVSFWTLLPTTGVRTRGSPLRLTLWPPRVPPSPPLALGPRMQLCTQLARFFPITPPVWHILGPQRHTPQAPLRLWSWCGTSQTYFGSRPSPCLSWSSRIVAPGHALSCRTRRRWSSKRWIFSNQLTVQMLCLPITHPFASQPLGQEMPNNTQIRLLKPCRVNAVEELHSRRMSVRIVKNWVSCCYVRLSAVGLSTWSALDEEKKNGRISSLKKKVNACSSLILSFQRVKTGMEILLWILLKMEIQIFKICLGEMQLCGQAFGSFSADFSAPQIIKKMKKRIMVHELKKNLLLPMCSSLALPTGLTSLILPSSDLAVLISSSTSHFLMRSPVLPSSRLTCASPQLPRMWTWSSWLKNEGNNHWPRVEMPTGWLLVGYNTRNTAQNPRLQQHLKHWQQCTRARWCQEPCQTLTFFHFFFFFKTVSLCCPGWSKGQPPPPGLKPSSLASQVARTTGVYQHVWLICFVFFVCVETGFCHVAQVGLERLVSLSGITDVNHWAQPKPSPSKGTGMNRPIGLRVGKGVWARLILAMTLTLNGMAKKSQQPLQVVLRLGNLPPFFRGSEVPFPRPCRTKPACTSKAWTPRKLVGRAVRRKGSPLWDCSTTTGTHHGCLWEIPSVTLLAHPRTASITLPTTSLKGSRTSCCPRSHPRLPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRRCQKKVPSASPWGLVLKKNRKQMLNQKCLAPFRESTLGNFWMKLLQLPVVINLKRLQKFNLHLCYYHSQSNRNKSRQMESLGMKLQSQKSQHHCALRKIEWATKLSLGGKAGPQAQEKATSRILNLQVLKKILRSFMKLYHSLVMCLRLRTKLEKALSALFIWPQHSYKPLFFHGDLCEWGGQAHRQRNWLKNWKRFKLKKKYIQKKKQKSNKIICKGHRITIICIKNMFLQRKGFLNLSHVEKFCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIFTAKKSPTSFCCNILNSLPSSMEIAVLQEDSKKMTQKGQAFGSLCQLVSADFSAPQVTRLRSLNHLLITYTPHICRHTLLTPDTRWIFSNQLQTVQMLCLPPLKQGERIIWPLGGFQIPNFFWSLGIGHTGAWWHTGRRRREWGGSTVSRSPLWISSMIYLRGMAFASDSSIRTTRVSWCRRCGAKSAAASSIEALTALFTCRTASISVNISTLMSILEALKKKPRDICRISCRCRREYRVTMGYPYDVPDYAS

SEQ ID NO: 1187 - DNA, 4641 bp, Artificial Sequence
  Polynucleotide encoding the hTPA- and HA-extended poly-FSP polypeptide 1C
atggatgcaatgaagagagggctctgctgtgtgctgctgctgtgtggagcagtcttcgtttcgcccagccaggaaatccatgcccgaagcaccagacgggaaatgccttctcaggccacaccttctccacctggaccttggagagccgctctgggcaaagaagtgaagcggagccagagcaagctgcggctgagaaacacaagccccaccgagatccaattgaccatgaacgacagcaagcacaagctggaaagccccgctctgaaacaggtgtcccctgcctctccacctacacagcagcctcagacaccccaggatagcagacaggtgctggccgcttcttctcctggacatcctcttggccctggcgactgccctagaacaatggctggaccttctgcctctctgcacccagcatctggcagagccagcagaaagacctggcagagaaggctgagagcctgtagagctggtggacctgctggatgggctagacaggccatgacactgaaggccctggtcaagacctggacacagttcagaaactaccccagagtcggagccggaacaggcggaggacctgcttgtgttcctgtggccgaagcttctactggcgcctggacagctgaaggcgctgccggaacaagatgcagagcttctagagccccttgcagacagctgcctgccagctctcctaccaagtgcgagatctgcgtgaagagaaggcggcggagaaagcggagcagccagtctagatctcccgtgcctaagaaacgcgagcggatgatgctgcctgtgcgggccagaacagctagatctgctctgccacaaggcagagcccctctggaaggaatgcttctgcctagagcactgcccagcctgctgagcagaatgccagccagaagagagagccggttttggctggcactgcaggctctgggactcagacctcctcatctgcctagctgtcaccctctgcctcaactgcttggacctcctccacctcatcaggcccctttcgacaagaaaggcttcgtgatcctgagcaagggcaagaagcgccggaaagaaatccggcggatgaccagacggaccatgaccaccaccaaaatgatgatgatgcggcggaccaagcggcggaggcgaaaacgtagaagaatgaccatgatgacccgcagaaccctgctgaccaagaaaacctgtctgacccctagaaccagcgccgccacaaaagctctgcccagacagacaatcagccagcggaggcctatccagacacctcctggaacaagcctggccatctggggcagactgcctctcagaccacagagaggacctcggcctctgcatagatggctgcagcagacaacaggctgctcccagagaagaatcgccaagaagcggatcaagctgaggcggaacacactggccatccggtttatctctgcccctcagcctagcagcagcaccgttacagctgctcctagcggccagtacttcagcagcttcttctacaccagcgaccggaccaagtgtgaaatctgtgtcaagaacaccgccatcctggctatcaccctgatcacccctcaggaccctcacctggaccctgtgtgtcacccacatagaaggcctggctggaagggccaccacagagtggtgtttagccaccatccaagcggctccaccaagagccattggcagcagagagaaagaggcggaggccgcagagaaaaaaagggctgcagagagatgcccagcagctggtctagctctggcagaaccgccgacaaaaagaacgtgcggagcagaaccagactgaccctgacaggcacaagaagcagcggcacaagagcctctccaagcgccgtgtgtctgtgctgttggacatgcccctccagaagcttccctgccgcatctccatctggactgagagcacctgttggagcccaggctcctcctgaagtgacactgagagccagctgtgcctctagcgcctctaaagcctgtgctggactttggccttggggagcccaagtgcggaacaaagtgcggcagaacttcaagcggaacctggccaaaaagaccctgactaacgccctgcggagtatgcccaagagcagaaaccaggtgctgttcagacggaatctgaccccaagccagctgagaactctggcccctccttacatgctgctgccccagtctctgtctcagagcctgtccagaaagcagatccccagccaatcaatgctcgtgaccgccttcttcctgctcgacatcatcctgagaagcctgctgtactcccggatgtgcctggtgcagatccctacacacacctgggagcccgactacttcgtgtccctgcctatgatgttcagctgggccactcagagctttccagtgggagccgtgttcctgaccagacctgccattccttgctgcagctgtaccagccacagcaacccttggagccagtccttcaagaagaagaagcccctgacattcagccccagcgtgccaatgtctctggcctgtagcatcaccgtgtccttcgtgggccagatcagcacactggtgctggacgtgtcctccatctctcactggcgcaagcgcaagagagagaagcggtcccagaagtcccggcagaaccatctgcagctgaagtcctgcagacggaagatcagcaactggtccaagctgagatccccgtggatcttctaccctcggctgaaaaccttcggcgtgccactgggctctatcctgtgtctggcaggctccctgagcacgatgatgatcattagcaccaccagacaagagtgtggcagacgggcctccgtgccttgtagacctatgatcggcagcgctagacccggaccttggcggacatctgctatgccatctgccatgggagtcgccctgcctaccagctgtgaaagcggaagatctcctcctgccaccggcggaagaatgcctggatctcagtctatcatgatgagctggatgcctccactggctccctgtgccgcttgtccttgttctcctgctcctacactgtgccctgctcatcctgcaagagcccctacagccgtgcctgcctttacacctctgtctgctcaccctgtgccagtgctgtctggatgtcacctggccgtgcgcacctctatgctgacactgctgcccatgagacaccctcacagaagcccacctacaagctgccctccactgctggaagctttcccactgccaagggccagcctgagagctaccgtgcctagacacagctctgtgctggccactggactgcatctgcatcggcagattagcctgcctctgaggggcttcctgctgcatcaacctctgcctggacaacacctgtggctgtcccacagactgaggctgagactgccaagaacaggcgagaagaacgacctccagctgttcgtgatgagcgacaccacatacaagatctactggacagtgatcctgctgaacccctgcggcaacctgcacctgaaaaccacatctctgcggagagccagacctacctcctgcagcacatgcagaatgtggtggctgaagctggccccactgcaagtgaccacaacactgaagctgatcctggtcatgctggaaatcgtgaccgaagaggccaagaaatccatgaagagatcccggcggagcaagatcgaggcctctcctatcggctccatcatgaagaagaaagacagcaccatcttcatcaaccagcagctcaagtggacccctcacatcctgaagtctgccagcgtgtccaagaagagactgcccaagctgaacggcatctgggaagtgatgccccggacactggaaggctgcatcagcgtgaaggaccaccggacaagccagaaccacagcaagtgcatcaccgagtgtgtgcggacagccctgaaccagagaaaggtggtcaagaaccccagccagccagtgccactgagaaacgacggcatcaccaacggcaacgactccaccagatcctgctccatcagcctgaagaaaagcctggaaaagatgcccctgatgaacgccaagaaaatggaagatatgatctgggagagcaacatgggcggcaaccggtccatctgcctgacaagactgccctgcaaagtgaccgagtccagccaaagaccacctcggagcattctgtccctggcctctagagccggacagtttcccgtttggcggagaaccagcagaggcatgtccctgcagtggaagtccggcaatgcctgcacacctctgaggtgccctagcagaagccctgccacatttctgaccgcactgaacggctggcacagatctggacttagggctcagcaacctagcctgccaggaccttgtgctagcctgctgtctacactgagccagcctccaccacaggctccaagccaagtttggacagccgccacactgagatgtcccgctgttcctgcagctgcttgccctcctatcgtgttctttctggccccatacttccccacaccactgagcatcagcagacccacctctcgggccagacagtcttgttgtctccccggactgacacaccctgctcaccagcctcttggctctatgggctacccctacgatgtccctgactatgcgtcc

SEQ ID NO: 1188 - DNA, 4623 bp, Artificial Sequence
  Polynucleotide encoding the hTPA- and HA-extended poly-FSP polypeptide 2C
atggatgcaatgaagagagggctctgctgtgtgctgctgctgtgtggagcagtcttcgtttcgcccagccaggaaatccatgcccgacggcagatcaacagacggaagctgcagagaaagaagcgccggaagaagagagaggaccactgcggactgcgggccagaaaccggaacatgaagaaaaccatgagccacctgatcgcccatcaggccctgaagatgtctggcctgagactgtttcaccccagactgctgacacggaagaagcctggcaagaaccctcggagaaagacctggaagatgcggaagaagtacgcccagaagcctagccagaagaaccacctgtacggcaagggcctgacacaccctgtgcctctgaagagaaccctgcagaacaagcggaacaagaacatcaagcgcgtgaaccagaagaagggcaacatcaagagaaagagcatcctgctgcacctcatcgtgctgaacagccccgagagcaacctgcaggctcatcctcaagttccagcactggctcctcaggcttggtggcctgctagaagaggccctctgacaagcgctccatctgctcagcagagcctgaccttcctgcctagcagatttccttggggccctcctccactgcactggaactctgcctacctgggcagaacactgctcgtgacctgcatcctgtaccacagatggatcgtgaccagcatgtgccagagccagagatggctgaccagcaccacctctagaagcagcgccctgatgtggacccagtggtctagcgtgacaagcctggaatggacagcccaagagaggggctgtagcagctggctgatgaagcagacctggatgaagtcttggagcctgcgggaccccagctacagatccatcctggaatacgtgtccaccagagtgctgtggatgcccacatctacagtgggagccctgagagccacagctcctgcaacagctgctccacaggctcagacccctcattggagagccgccacaacaagcagcatgagcagcagccctagagccgagcctacaagctctagctcttgggccacctgttggcccagatgttgcagctccagctgttactggtccctgtcctcttggcctcctgctggtgctgccgaggccacaaataccaggaccagaagcagagagtcccagcggggcagaatgctgacttggagaagcagcctgtggctgcagggcaccagatgttttacaggcgtgcggacctccagcagacacccttcttggccttggaccagatgcctgagaatgcggcctcctagaagcaacagccggaaaaagctgctcgaggacatgaagcaaaatggcttcacccggtacaagaaacggggcgtgatagcctggcggagagccactttcctgctggccctttgggagtgcagtctgccccaagctagactgtgcctgatcgtgtctaggaccctgctgctggtccagagcagatgcagcctgatggaacagatccctcacctgaagtcctggtggtgtacaagaggcggcggaaagcggaagaaaaagatgtgcaaggtgtccggcggctgcaccgcctgtgttgaaagatgtccttggaagggcatctgctggaagtggcctgtgacagtggccgctctgatcctgattcagcacggcggcatcttcaccttccggttctgggtcgagaagctgtcctggaacatctgcaagaatctgtccctgtacctggacaagttcgtgcagcggctgctgtacgtgtacatcatcgagacaaacgtgttcgtcctgaacctgttccacgtgccagtgaatcagatcttcatgatggccttctacctgaagtacaccgagaaggcctgggtcatggaactggaatggctcattcagcagcagtgctaccagttgctgctggctcatatgtacggcttcagcacctacggcacccagaaaggcgagtgcgtgtgtctgcagtgtctgagcggcagctccctgttcatcctgaagcagccactggacctgaagatcagcaagaccttcatgagcagatcccacctggatttcagcccctattggatgaagaaagtgaaggcctctccacagatcatgcagcggatgagcgccgtgaacttcgagacaatcaggcggaagtggcagatccggcacgtgctgaagaacctgcctctggaaaacacacagatccccaggacaagccctctgtggaagatcacaatggtgctgacataccccaactgcgtggtgcatgtgctgatgttcgtgctgttcaaggccgaccagagcgagtctagcctgagcagcggaatctaccctcctagcacctgtagcctgccttgccggggcattagaatgtgcgccctgtctcaccctagcttctacatcagcagcaccgtgtgctttctgagcaagcactgcatgaccgcctgcaccagagagaagatcatcaaccccaccatcagctgcccctttcagagccccacaaagagactgggccacagagagggcagcgagagcgataatctgggcctgctgtactcctttcctccttggctgcccatgagatccctgggcgaaccttggagagctggctttcagtggggagagtccccttggcaagtgatggctagcctgaccggcaacagcgtgatcgtgcacaagatcgtgctggtgtttctgaagtctctgagcagctacaactgcgagcggcggatctctggcatccagaagagagccatcgagttcgccgtcctgaagctgctgaacatggacctggctagccctcagattatgcagagaaccagcgccgaccggttccggatgaagcggagaatgcagaacctggataacctgggcgtgccctggccattgcttccaggtgctgctcctccacatagactgctgggcccctctagatggattctgtttcatgtgcggaacatcgtgtacggcatccaagtgatgctgtgccggcggagaaacagcagaaagcagagtcaggtgcagctggccattcaggtcctgctcgtggacaagcacaagtactttctgttcggcccctatcctatcagcgagggactgaccatgaccaccggccggaacatcaacagcaactccctgatgaccaactgcctgttcagccccatcttcctgtgccaccacgccatcatgcaccggaagatgacaagcccacacttcagactgttctccagcaagatcccacatcctcaggtgccaagtgtggtggccctgtgcaagttcctggccaatggcctgtggttcaacctgatctttcagaaaaagggccacatgatctttagccccaagttcttcctgacctttagccagcggaccctggaatccgccggactgtttccatggctgcacacccagtgccggaacaaaaagaccaagctgtggttttccctgatcaacatccaccaccgcaagaatcctctgctgcctatgagaatgagcagaacacctcctcggagagtgtgcggatctccacctctgcatctgtgccaacctctgagaggcggcaagaagagaagcaagttcgccttctggaagcctcctagccagggcatcagctcttgtctgatgacaggctgttggggctcctgtggcagagcttgttcttgcggaagaggctgcggtacacccagaggcgactggaaaagacacccacctcgcagagagctgagcctggaaccatggattccttatctgcaccagcaaaagacccagcggaagcggatgaagaccggcgccattcaagagaagggcgctatccaagaaaaaggcgcaatgaccaagcggatctgcgtggtcaatttcgaggcctgcagagagatggaaagcctgagcgcccctgagaagattaccctgttcgaagcccacatggcccggtgcacctccatcaatgtgctgtgtgtccgggccagcctgattgagaagctgatgaaagaaaagcgcaagatgaagcgcaaccaggtggcatcccctcaaatcatgcaacggctgttcatcaagggctaccagaacaaccacttcacgttccacctccaaaactttgccttcttcagctccttcggcaacaacaagtatatcaacattctcacccgggccttcatccacacacctagaagccctggctgttccgtgtacgccaatatgtgctggcggaagatgcagtccctgaatcaccccagcagactgaccaactgtcaccccgcttggctgagccccattagtgcttgtcctaggctgctgccctatccttttcacgtgctggcactggaagtgacctttccacctggcacagccatgcctcagatgcaattgcaggcactggctatgtgggagaaaggctgggacaagcaagagaagaaatcccgcaagctgatgtcctcctgcctggaaaaaaaggctacctggatgcggagaacccctggcacaagcctgcagtgttacctgaacacacacccctgcaccatgctgctgcctcagggaatcccatctctgaacgcccagtggatgttcctgcggatcggctacccctacgatgtccctgactatgcgtcc

SEQ ID NO: 1189 - DNA, 4638 bp, Artificial Sequence
  Polynucleotide encoding the hTPA- and HA-extended poly-FSP polypeptide 3C
atggatgcaatgaagagagggctctgctgtgtgctgctgctgtgtggagcagtcttcgtttcgcccagccaggaaatccatgcccgacctattcctccacacctgagacaccctctgctgctgaagaacaagaagcggagaaagctgcggcccaagagcagaaagaagggccacaccaagaaccggcggaaggccaagagaaagccccagatcagaaacagccgcagagccacacctaccagcaagggcagcctgagaagaaagtacctgagagtgggagccgccgctgctagctgtcaatctcctccatctcctagagagacaacccctagcagcgacgccaccagaagaaccagacctatcgccgctcagagcaagaaaaccatgacagccgccggactgacccctagccagaagaaagatcctgccggcaagctgaagaaacaggtgtccgtgtacagcggcaacctgctgagcttctctcggagaggcatgaagtctagcgtgcgcctgaagaactgcaccaacctgagcgtgcccatgatgctgaccatcctgatctggaagcgggtgttcatcctgctgctgtccgacaagaaatctatccctcacgtgcccaaggccaccgccgctcattctgtgacagtgaagctgcagagccggcggaacagacggtacagaaagatctatggcgagctgaagatgtccctgcaggccagcaatggcatggaagcctgtggcacacaccccacacctagactgtccgtgtccgtgatcaccatgaagctgtgggagaagcacttcaagggcctgaactggaacctggtcgtgtggattctgaacctgaagatgatgctcaagaagaagtatctggtccagcgcgagtgggagaaacggaagcagattcttggcggcggaggcaagtacaaagagtacttcctgaagagaatcctcatccgcaaggccatgacagtgctggccggcgataagaaaggcctgggcagattcatgagatgcgtgcagagcgagacaaaggccgtcagtctgcagctgcctctgggcagaatggacctggatggaatgctgaccgtgatcggccagggactcgtgggcatgacacctagagatctgggaacagtggctggcgccaccgcacagattcagaggcctattcaggtgcagacaggcggcagactgagaggccctagaagaaaggtgctgatggtgctgtggctgcccgccaatcagagcctgcagaaaagccaggtgttccagtgggtgctgagaaccgagctgcccctgacctttagcaccctgctgtgggacagcagacacgacctgcctagaatgctgcccatcagcagccctctgcacagaccccagatgcctttctggacctgcacctttcctgccaccacatggggcacatgggagacaccttctacatggggctggcggacctttgccagacagccttctagacccaccggcagaacccctaccaccagactgatggctccagtgggcagcgtgatgagctgtagcctgctgacacagccatctccagccagcgcctgtacaatgcctccactgctgcatcctcagtgggcccctcattctgctggactttctccaggcgcttgcagacctgcctgtacctgcatcagcatgaccacaatcagcagggccacctggcgcagaaacctgcagagaaacctgaaagtgctgcggctgagaatccccagcctgcggaagtacagacagcagaacacccggtccaccaacctcgagaagaacccatctctgaagaagcagagccagaggcggggcaagctgtctctgaccacactgagcttcgtgctgatcgaggaactgctgaaaaagagcagccagctgcggagaagctggcggaacgtgtccagaatcagcaacatccggaagctgatttggaccaagcagcggagcttcctgtctctgttccccaagctgagagccaccgagcagatgaccaatgtgggctgtagactggattttcaccccagaagcagctccggcgacagagtgttcctggtcaagatccagagcagcccattcctggccagatcctggaataccatgcagtggaacaacaagaaaatggccatgactgtgatcgctggcgcccaccactgtcagtacaagctgacctacaccaaagtgtggaagatgaattggaagaaaatgatgatcggcagccagcacctcctgttctccccactggatagctctccactccagctgctgctgcacccacacggcaagagatgcaacccctgttgtcggctgacatggatgagccacctgaatcggaagctgcacctcaccaggtcctgcctgatcgacctgaccatgatgatgagccagaaactgtggaagaatcagcggaagcgcatccctctgccttctccaagacagcatctgctgcctcagtatcctctgcaccctcctccaccttgtctgctgcttctccaccatagacaccacctggcattcctcgagatggcctgtagctctcagcacacccacagcatcaagatctggatcagcttcagccacgagacaatgagcctgtccaacatcctgatgaagttccggctgaccaccaccacaagcagccccagaagaagccctgctctgcgagctagaggcggcacaacaatcggcgaagtgaccagcagcctgttctttagccactgcctgtgcgtggcccctagatgtcctagatctgccgtggacatcagccccggacctacatctccttctctggcctcttgtgcctctgtggccattggaaagctggcactgcttggcgcctctgctccttgtggtgctgctggcgctagagaggccggaagatttgctgtgctgggcaccatggtcatgaagaacatggaacacagactgaccatggacagcgccctgagcctgacaaagagagagggccctgaaacaggccccgtgtactacgtgtgcaaccggatgaatgtgtccagcgtgctgaagcctttcctgttcaccgtgcctatcgaggacatgagagagtgcaccctgggacgcaacagaatgaatgtctcttccgtgctgaaaccctgtctgatccccgtgccaatctgcaagaagaaactgctgctcaagctgctgaggggcgcctccagctctaccagcagagatagcagaagctttttcaccagcgctcaccccagcagaccctgcaggatgagactgtaccagatgctgcagaagcagtgctgctacaacctcgtgatcaagcaccctctgatcttccggatcaacctgcggagacagggcaagaccaaagacggcgttgtgcagagcctgggcttcctgaaccagcagatcatcctccagaaagagttcttcatctgcctgctgatgttcatcaagcggtggaagccagccgccaccaagaagggcaagaacagcccctgctgccagaaaaaactgcgggtgcagaaccagggccatctgctgatgattctgctgcacaacagaggcccacctctgcataccagattcgagaaaaagcggcccgagtggctgagcagaaaatccggcgtgatgaagtgctgggatctgtgccctgccttcagcggcaggattctgcaccagccagaaatggccgccatgagactgatgcccaagttcctgaactccaccaacagctggtggacagtgcacaagaagagaggcctgttccaccagatgaagtgtctgaccgccgtggactgtctgcaggccttctgggatatgagcgagaagaaacgcaagctgcctatgattcgcaaaatccagaagcggcggagaaccgccaaccggaacatcgagatcacccctcagagaagcaaagcccacctgaagaaaacctccgccaagggcgccaagaaaatcaccttcctgtgcctgagagtcagatgcggaggctggctgtgtggctggacaccaagaggatggctgaagaagtccaccaagtccagactgtgcttcttctacctgctgtactacctgtttttcctgaccgtgtgcggcttcacccctccaccacttattctgtggcctcaggcagcccctggcgagaagctgaagcactgttttaaagcctggggcgtcgaccctcctggcagcgtttggattctgccctgcttcctgattcacctgagaaaggtggacacccaccacctccaggtggtcaccaaaacagtgaccgccacaacagccgacggccagaggatgagaaggctgaagtgcaaggcctgccggctgagatgggctagacctgaacctgcagctcaggcccctcctaagagccactttccacctcatcctagcggcccctccagaaccagctctctgcaattgagaacctacatggaaatgcactacggccatcaggccccacaggtggcaatgctgcctaaactgctgtgtcggcagatgctccccactctgtctaccctgcagcagagacatcctcagggcccatgtcctcctccagtgacacctctgagagtgcagtctgtgctgctgctcggagtgcctcaaacagctggctacccctacgatgtccctgactatgcgtcc

SEQ ID NO: 1190 - DNA, 4641 bp, Artificial Sequence
  Polynucleotide encoding the hTPA- and HA-extended poly-FSP polypeptide 4C
atggatgcaatgaagagagggctctgctgtgtgctgctgctgtgtggagcagtcttcgtttcgcccagccaggaaatccatgcccgagacagcaagaagatgacccagaagaaccgcaagacccggaaggccgccagagagaagcacagaaagaccgacaacctggacctgcagcaccagcgcagacgcaaaaagaagaaggacaaggtcgagatccggaatcggagccctaaggccaatagcaccgagtgtcagggcgagcacagcagagagcagaacctgctgaacctggtgcaattgaaccctcacagccctcaccaccggaaggacgaggaagatcaccagaagagacaccaccaccacaatcaaaagaagatgtccgtcaacgagggcaacaaccactggcctagagtggaaatgcctaccggctggctgctcgtgggctacaacaccagaaacacagcccagaatcctcggctgcagcagcacctgaaacactggcagcagtgcaccagagccagatggtgtcaagagccctgtcagaccctgaccttcttccacttcttcttctttttcaaaacggtgtccctgtgctgccccggctggtctaaaggacaacctcctccacctggcctgaagccttctagcctggcttctcaggtggccagaaccacaggcgtgtaccagcacgtgtggctgatctgcttcgtgtttttcgtgtgcgtggaaaccggcttctgtcacgtggcccaagtgggactcgagagactcgttagcctgagcggcatcaccgacgtgaaccattgggcccagcctaagccatctcctagcaaaggcaccggcatgaacagacccatcggcctgagagttggcaaaggcgtgtgggctagactgtggctgaagaactggaagcggttcaagctcaaaaagaaatacacaggcatggaaatcctgctgtggattctgctgaagatggaaattcagatcttcaagatttgcctgggcgagatgcagctgtgcctcaagaagaaagtcaacgcctgcagcaacgccaagaaaatgcccttccagtgccggtgcagacgcgagtacagagtgaccatgattcagaagaagaaacagaagtccccgctgttcttccacggcgacctgtgcagaccttctccttgcctgtcttggagcagcaggatcgtggctcctggacacgccctgagctgtcggactcgtagaagatggtccagcaagatggccaagaagtcccagcagcctctgtgtagaggcggcccttctgccagcgatagatgctgtagctgtagccccagcggctttagcgctggaagaggcagatgtcctgtgcagggatgtctgaggccacacagagttcagctgctgagaagatggggccctggatctcctgctggccagagactgtctaagggcttccaactgctgcgttggtggggaccaggatctccagctcctgagcctagaaagggcccatttccaccacctgatcctccatggcctgtgaccgctgtgacagtgatggctggctctgtgcctagcgctcagtctgtggatgctctggaatcccctggacctctggctctcgaaggccctagcagccctagaaacctgctctggcgggaaatgagcatcttcctgcctggcatcttcaacctgcacctgtgctactaccacagccagagcaaccggaacaagagccggcagatggaatccctgggcatgaagctgcagatcacacacccattcgccagccagccactgggccaagagatgcccaacaacacccagatcagactgctgaagcccggccaggcctttggcagcttttccgccgatttttcagcccctcagcaggcccctctgagactgtggtcttggtgcggcacaagccagacctacttcggctctatcgaagccctgacagccctgttcacctgtagaaccgccagcatcagcgtgaacatcagcaccctgatgagcatcctggaagccatcctggccatgacactgaccctgaatggcagccctctgtgggactgcagcacaacaacaggcacacaccacggctgcctgtgggagatcccttctgttaccctgctggctaccgccaaaaagagccctaccagcttctgctgtcagcggcctcctctgcagccagtggaagagaagaagaacggccggatcagcagcgtgccaccttctccacctcttgctctgggccctagaatgcagctctgcacccagctggcccggttcttccctattacacctcctgtgtggcacatcctgggacctcagagacacacccctctgctgacccctgacaccagatggatcttctccaaccagctgcagaccgtgcagatgctgtgtctgcctccactgaagcagggcgagagaatcatctggcctctcggcggctttcagatccccaacttcttttggagcctcggcatcggacacactggcgcctggtggcatactggaaggcggagaagagaatggggcggcagcaccgtgtctagaagcccactgtggatcagctccatgatctacctgagaggcatggccttcgcctccgacagcagcatcagaaccaccagagtgtcctggtgtcggagatgtggcgccaaaagcgccgcagccagcagcgacaagaagaagaaaagcaccgaaaagaccaagaacaagatcatctgcaagggccacagaatcacccaggtggtgctgagactgggcaacctgcctccattcttcagaggcagcgaggtgccctttcctagaccttgccggaccaagtgccagaagaaggttccaagcgcctctccttggggactgcacccaagaacagcctccatcacactgcctaccaccagcctgaagggcagcagaacaagctgctgccccagatctcaccccagactgcccagaacaaagtggcctctgcagtgcctgctgcacagcctgggaacaactggaacactcgtgtgggaaaggggcgtgctgcagatgagaagtctggaagctcactgccctctgcagacattccacctccaccactgcagaacccagcctagctcttgtcctccagcctggattctgtaccaaggacagtggagcggagccgtcgtgggacttagacctgtggctcaccatctgccaagacctatccaggggctgcactgtcctcaggctcctcatcaaccagctctgtcctggggaaagtggcccgtgggaatgacaggacccgccagatgttgccggtggcctagaagaatgtgtagctctctggccctgccaaccggcctgacatctctgatcctgcctagcagtgatctggccgtgctgatctctagctccaccagccactttctgatgcggagcccagtgctgccaagcagcagactgacatgtgcctctccacagctgcctcggatgtggacatggtctagctggctgaaagagtggggaggacaggcccacagacagcggaactgtagagtgaacgccgttgaggaactgcacagcaggcggatgtctgtgcggatcgtgaagaattgggtgtcctgctgttacgtgcggctgagtgcagtgggactgtctacttggagcgccctggattccctgatcctgtccttccagagagtgaaaaccagccggatactgaacctccaggtgctgaagaagatcctgcggagctttatgaagctgtaccactctctcgtgatgtgcctgcggctgcggaccaagctggaaaaagctctgagcgctctgtttatctggccccagcacagctacaaaggccaggcattcggaagcctgtgccagctggtgtctgccgatttcagcgcccctcaagtgaccagactgcggagcctgaaccatctgctgattcggtggatctttagcaatcagctgacagtccaaatgctctgcctgccgatcatcaagaaaatgaagaaacggatcatggtgcacgtcttgaagaagaatcggaagcagattatctgtatcaagaatatgttcctgcagcggaagggattcctgaacctgagccacgtggaaaagttcagagagagcaccctgggcaatttctggatgaagctcctgcagctgccaccagcttgcacctctaaggcctggacacccagaaagcttgtggggagagccgtgcggagaaagggcgtcgtgatcaacctgaagagactgcagaaattccgggctagcgtgtccttctggactctgctgcctacaacaggcgtgcggacaagaggctctccactgagactgactctgtggcctccaagaagccagaaaagccagcaccactgcgccctgagaaagatcgagtgggccacaaagctgtccctcggcggcaaagcaggaccacaggctcaagagaaggccaacatcctgaacagcctgccttcctctatggaaatcgccgtgctgcaagaaatgctgaaccagaagtgtctggcccctttcgagcttaagaagaacctcctgctgccaacctacacaccccacatctgtcggcacacccttaaaaagaagcccagagacatctgcagaatcagcggctacccctacgatgtccctgactatgcgtcc

SEQ ID NO: 1191 - DNA, 4641 bp, Artificial Sequence
  Polynucleotide encoding the hTPA- and HA-extended poly-FSP polypeptide 1D
atggatgcaatgaagagagggctctgctgtgtgctgctgctgtgtggagcagtcttcgtttcgcccagccaggaaatccatgcccgagccgacaagaaaaacgtgcggagcgctagttctcctggacatcctcttggccccagaagaatgaccagacggaccatgaccaccaccaaaatgatgatgatgcggcggaccaagcggcggagaagaaaaagacgccggatgaccatgatgaccagaagaaccctgctgaccaagaaaacctgtctgacccctagaaccagcgccgccacaaaagctctgcccagacagacaatcagccagcggaggcctatccagacacctcctggaacaagcctggccatctggggcagaagaagcaagatcgaggcctctcctatcggcagcatcacccctctgagcatcagcagacctaccagcagagccagacagagctgttgcctgcctggactgacacaccctgctcatcagcctctgggctctatggttggagctggaacaggcggaggacctgcttgtgtgcctgtggccgaagcttctacaggcgcttggacagctgaaggcgctgccggcacaagatgtagagccagcagagccccttgcagacagctgcctgcttctagccctaccaagtgcgagatctgcgtgaagagaagaaggcggcgcaagcggagcagccagtctagatctcccgtgcctaagaaacgcgagcggatgatgctccctgtgcgggccagaacagctagatctgctctgccacaaggcagggctcctctggaaggaatgcttctgcctagagcactgcccagcctgctgagcagaatgcctgccagaagagagagcagattctggctggccctgcaggcccttggactcagacctcctcatctgcctagctgtcaccctctgcctcaactgcttggacctcctccacctcatcaggcccctggcgagaaaaacgacctgcagctgttcgtgatgagcgacaccacctacaagatctactggaccgtgatcctgctgaacccctgcggcaacctgcacctgaaaaccaccagcctgaacgccaagaaaatggaagatatgatctgggagagcaaccagcagctgaagtggacccctcacatcctgaagtccgcctctatcgccaagaagcggatcaagctgcggcggaacagcaccagacgggaaatgccttctcaggccacaccttctccacctggaccttggagagccgctctgggcaaagaagtgaagcggagccagagcaagctgagactgagaaacacaagccccttcgacaaaaagggctttgtgatcctgagcaacatgggcggcaaccggtctatctgcctgaccatcgtgttctttctggccccttacttccccatgcctagcagctggtctagcagcggcagaaccagactgcctctgaggccacagagaggccctagacctctgcatagatggctgcagcagaccaccggctgctctcagagaagaggcgactgcccaagaaccatggccggaccatctgcttctctgcaccctgcatctggcagagcctccagaaagacctggcagagaaggctgagagcctgtagagcaggcggacctgctggatgggctagacaggccagaaaacgcaagagagagaagcggtcccagaagtccagacagaaccatctgcagctgaaaagctgcagacggaagatcagcaactggtctaagctgcggagcccctggatcttcgaggccaaaaagagcatgaagagatcccagcggcctcctcggagcatcctgagcctgttcaagaagaagaagcccctgacattcagccccagcgtgtccaagaagaggctgcctaagctgaagggcaagaaacgccggaaagaaatccagcggaaggtggtcaagaaccccagccagcctgtgccactgagaaatgacggcatcaccaacggcaacgacagcacccggtcttgcagcatcagcctgaagaaaagcctggaaaagatgcccctgatgcggagcctgctgtactccagaatgtgcctggtgcagatccccacacacacctgggagcccgactactttgtgtccctgcctatgatgttcagctgggccacacagagctttccagtgggcgccgtgtttctgaccagacctgccattccttgctgtagctgtaccagccactccaatccttggagccagtccacactggccatccggtttatctctgcccctcagccaagcagcagcaccgttacagctgctcctagcggccagtattttgccctgcggagtatgcccaagagccggaaccaggtgctgtttcggagaaatctgaccccaagccagctgcggacactggcccctccatatatgctgctgcctcagtctctgtcccagagcctgtctcggaagcagatcccatctcagtccatgctcgtgcggaccaggctgacactgacaggcactagaagctccggcaccagagcctctccatctgccgtgtgtctgtgctgctggacatgccccagcagaagctttcctgccgcctctccaagcggactgagagcacctgttggagcacaggctcctccagaagtgacactgagagccagctgtgccagctccgccagcaaagcttgtgcaggactttggccttggggagcccaagtgcggatgaagaagaaggacagcaccatcttcatctaccccaggctgaaaaccttcggcgtgccactgggcagcattctgtgtctggctggaagcctgagcacgatgatgatcattagcaccaccagacaagagtgcggcagacgggccagcgtgccctgtagacctatgatcggaagcgccagacctggaccatggcggacaagtgctatgccttctgccatgggagtcgccctgcctaccagctgtgaaagcggaagatctcctcctgccaccggcggaagaatgccaggatctcagtctatcatgatgagctggatgcctccactggctccctgcgctgcttgtccttgttctcctgctcctacactgtgccctgctcaccctgctagagcaccaacagccgtgcctgcctttacacccctgtctgctcatcctgtgccagtgctgtctggatgtcacctggctgtgcggacctccatgcttaccttgctgccaatgatgaccctgaaggccctggtcaagacatggacccagttcagaaactaccccagacggcaccctcacagaagcccaccaacaagctgtcctccactgctcgaggcctttccactgccaagagccagcctgagagctaccgtgcctagacactctagcgtgctggccacaggactgcatctgcataggcagattagcctgcctctgcggggcttcctgctgcatcaaccactgccaggacaacacctgtggctgtcccacagactgagactgcggctgcctagaacaaccgagatccagctgaccatgaacgactccaagcacaagctggaaagccccgctctgaaacaggtgtccccagctagtcctcctacacagcagcctcagacaccccaggattctagacaggtgctggccgtgcctatgagcctggcctgtagcatcaccgtgtccttcgtgggccagatctctaccctggtgctggacgtgtcctccatcagccactggaacggcatctgggaagtgatgcccagaacactggaaggctgcatctccgtgaaggaccaccggacatcccagaaccacagcaagtgcatcaccgagtgtgtgcggacagccctgaacaccaagtgtgaaatttgtgtgaagaacaccgccatcctggctatcaccctgatcaccccacaggaccctcacctggaccctgtgtgtcatccccatagaaggcccggctggaagggacaccacagagtggtgtttagccaccatccttccggcagcaccaagtctcactggcagcagagagaaagaggcggaggccgcagagaaaagaagggctgtagagaggcaagcagagccggccagtttcctgtgtggcggagaacatctagaggcatgtccctgcagtggaagtccggcaatgcctgcacacctctgagatgtcccagcagatctccagccaccttcctgactgccctgaacggctggcatagatctggactgagggcccagaccgccttctttctgctggacatcatcctgcggagagcccggcctacaagctgcagcacatgtagaatgtggtggcggctgccctgcaaagtgaccgaaagctccctggccaagaaaaccctgaccaatcagcctagcttgcccggaccttgtgctagcctgctgtctacactgagccagccaccacctcaggctcctagccaagtttggacagccgctacactgcggtgtcctgctgtgcctgctgctgcatgtccacctctgaagctggctccactgcaagtgaccacaacactgaagctgatcctggtcatgctggaaatcgtgaccgagaacaaagttcggcagaacttcaagcggaactccagcttcttctacaccagcgacagaggctacccctacgatgtccctgactatgcgtcc

SEQ ID NO: 1192 - DNA, 4623 bp, Artificial Sequence
  Polynucleotide encoding the hTPA- and HA-extended poly-FSP polypeptide 2D
atggatgcaatgaagagagggctctgctgtgtgctgctgctgtgtggagcagtcttcgtttcgcccagccaggaaatccatgcccgacggaagatgcagagcctgaatcaccccagcagactgaccaacaatcctcggagaaagacctggaagatgcggaagaagtacgcccagaagcctagccagaagaaccacctgtaccggcagatcaaccggcgcaagctgcagagaaagaagtccagaagccacctggacttcagcccctactggatgaagaaagtgaagcgggccagaaaccggaacatgaagaaaaccatgagccacctgatcgcccatcaggccctgaagatgtctggcctgagactgtttcaccccagactgctgaccagaaagaagcccggcaagcagaaaaagggccacatgatcttcagccggcggaagtggcagatccggcacgtgctgaagaatctgatccccagcctgaacgcccagtggatgttcctgagaatcgctagcccacagatcatgcagagaaccagcgccgaccggttccggatgaagcggagaatgcagaacctggacaatctgggcgtgccctggcctctgttgcctggattgctgctggcccatatgtacggcttcagcacctacggcacccagaaaggcgagtgcgtgtgtctgcagtgtctgagcggcagcagcctgttcatcctgaagcagcccctggacctgaagatctccaagaccttcatggccagccctcagattatgcagcggatgagcgccgtgaacttcgagacaatcctgcaggcccatcctcaggtgccagctcttgctcctcaagcttggtggcccgctagaagaggccctctgacatctgctccaagcgcacagcagtccctgacacggacactggaaagcgccggactgtttccttggctgcacacccagtgccgggccttcattcacacacctagaagccctggctgcagcgtgtacgccaacatgtgctggcggtacaagaaacggggagtgatcgcctggcggatctaccctcctagcacatgcagcctgccttgcagaggcctgatcctgattcagcacggcggcatcttcaccttccggttctgggtcgagaagctgagctggaacatctgcaagaacctgagcctgtacctggataagttcgtgcagcggctgctgtacgtgtacatcatcgagacaaacgtgttcgtgctgaacctgttccacgtgccagtgaaccagatcttcatgatggccttctacctgaagtacaccgagaaggcctgggtcatggaactggaatggctgatccagcagcagtgctaccagcggaagagaatgaagaccggcgccatccaagagaagggcgctattcaagagaaaggggccatgaccaagcggatctgcgtggtcaatttcgaggcctgcagagagatggaaagcctgagcgcccctgagaagatcaccctgtttgaagcccacatggcccggtgcaccagcatcaatgtgctgtgtgtcagggccagcctgatcgagaaactgatgaaagaaaagcgcaagatgaagcgcaaccaggtggcatcccctcaaatcatgcaacggctgttcatcaagggctaccagaacaaccacttcacgttccacctccaaaacttcgccttcttcagctccttcggcaacaacaagtatatcaacatcctgacctttctgcccagcagattcccttggggacctcctccactgggagcccttagagctacagctcctgctacagctgctccccaggcacagacacctcattggagagccgccaccacaagcagcatgagcagctctccaagagccgagcctaccagctctagctcttgggccacttgctggcctagatgctgcagctccagctgctattggagcctgtctagctggcctcctgctggcgctgccgaagccacaaataccagaaccagaagccgcgagagccagcggggaagaatgctgacttggagaagctccctgtggctgcagggcaccagatgttttacaggcgtgcggaccagctccaggtgcagcctgatggaacagatccctcacctgaagtctaacagccggaagaaactgctcgaggacatgaagcagaacggcttcaccagacggcggaacagcagaaagcagagccaagtgcagctggccatccaggtgctgctggtggacaagcacaagtactttctgttcggcagagccacatttctgctggctctgtgggagtgtagcctgcctcaggctagactgtgcctgatcgtgtctagaaccctgctgctcgtgcagtctagacacccaagctggccttggaccagatgcctgagaatgcggcctccacgcagccactggaactctgcctacctggggagaacactgctcgtgacctgcatcctgtaccacagatggatcgtgaccagcatgtgccagagccagagatggctgacctccaccacctctagaagctctgccctgatgtggacctggtggtgtacaagaggtggcggcaagcggaagaaaaagatgtgcaaggtgtccggcggctgcaccgcctgtgttgaaagatgtccttggaagggcatctgttggaagtggcctgtgacagtggccgccatgagcagaacacctccaagacgcgtgtgcggccacagagagggcagcgagtctgataatctgggcctgctgtactcctttccacctgtgctgttcaaggccgaccagagcgaaagctctctgagcagcggcaacagcgtgatcgtgcacaagatcgtgctggtgttcctgaagtccctgagcagctacaactgcgagagaagaatcagcggcatccagaagagagccatcgagttcgccgtcctgaagctgctgaacatggacctcggcaagggactgacacaccccgtgcctctgaagaggaccctgcagaacaagcggaacaagaacatcaagcgggtcaaccagaagaagggcaacatcaagaggaagtccatcctgctgcatctgattgtgctgaacagccccgagagcaaccgggaaaagatcatcaaccccaccatcagctgcccctttcagagccccacaaagagactgggaagccctcctctgcacctgtgtcagcctctgaggccctatcctatcagcgagggcctgaccatgaccaccggcagaaacatcaacagcaactccctgatgaccaactgcctgttcagccccatcttcctgtgccaccacgccatcatgcaccggaagatgacaagccctcacttcagactgttctccagcaagatcccacatccacaggtcccaagtgtggtggccctgtgcaagtttacacacccctgcaccatgctgctgccccaaggcgctttttggaagcctcctagccagggcatctccagctgtctgatgacaggctgttggcagtggtccagcgtgacaagcctggaatggacagcccaagagagaggctgttcctcctggctgatgaagcaaacatggatgaagtcttggtccctgcgggaccccagctacagatccatcctggaatacgtgtccacacgggtgctgtggatgcccacctctaccgtgcctaagttctttctgaccttcagccagatccggatgtgcgccctgtctcaccctagcttctacatcagctccaccgtgtgctttctgagcaagcactgcatgaccgcctgcacacctggaaccagcctgcagtgttacctgaacctggccaacggcctgtggttcaacctgatcttccggaacaaaaagaccaagctgtggttctccctgattaacatccaccaccgcaagaacccactgctgcccatgcggctggaaaaaaaggccacttggatgcggcggaccgagctgtctctggaaccttggattccttacctgcatcagcagaaaacccagtggctccccatgagaagcctgggcgagccttggcgagctggatttcagtggggagagtctccctggcaagtgatggcctctctgacaggcagacgcaagaaaagagaggatcactgcggactgcaagagaaaaaaagccggaagctgatgtccagctgcgccgctcctccacatagactgctgggacctagcagatggggaagctgtgggagagcctgttcttgtggcagaggctgtggaacccctagaggcgactggaagagacacccacctcggcggattctgtttcacgtgcggaacatcgtgtacggaatccaagtgatgctgtgctgtcaccccgcctggctgtctccaatcagcgcttgtcctcgcctgctgccttatccattccacgttctggccctggaagtgacattccctccaggcactgccatgcctcagatgcaattgcaggcactggcaatgtgggagaaaggctgggacaagcctctggaaaacacacagatccccaggacaagcccactgtggaagatcacaatggtgctgacataccccaactgcgtggtgcacgtcctgatgttcggcggcaagaagcggagcaagttcggctacccctacgatgtccctgactatgcgtcc

SEQ ID NO: 1193 - DNA, 4638 bp, Artificial Sequence
  Polynucleotide encoding the hTPA- and HA-extended poly-FSP polypeptide 3D
atggatgcaatgaagagagggctctgctgtgtgctgctgctgtgtggagcagtcttcgtttcgcccagccaggaaatccatgcccgacagaacaccagaagcaccaacctggaaaagaaccccagcctgaagaagcagagccagcggagaggaaagctgagcagcagaaagaagggccacaccaagaaccggcggaaggccaagagaaagccccagatcagccagaagaaggaccctgccggcaagctgaagaaacacctgaaccggaagctgcacctgaccagatcctgcctgatcgacctgaccatgatgatgagccagaagctgtggaagaaccagcgcaagagaatccctctgccttctccacggcagcatctgctgcctcagtatccactgcatcctccacctccatgcctgctgctgctccaccacagacaccatctggcctttctcgagatggcctgcagcagccagcacacccacagcatcaagatctggatcagcttcagccacgaggacctgcctagaatgctgcccatcagcagccctctgcacagaccccagatgcctttctggacctgcacctttcctgccaccacatggggcacatgggagacaccttctacatggggctggcggacattcggccctgtgtactacgtgtgcaaccggatgaacgtgtccagcgtgctgaagcctttcctgttcaccgtgcctatcgaggacatgagagagtgcaccctgggcagaaacagaatgaatgtgtcctctgtgctgaaaccctgtctgatccccgtgccaatcctgaccacactgagcttcgtgctgatcgaggaaagccggcggaacagacggtacagaaagatctacggggagctgaagatgtccctgcaggccctgcctctgacctttagcacactgctgtgggacagcagacacaccaccaccacaagcagccccagaagatcccctgctctgagagctagaggcggcaccacaatcggcgaagtgacaagcagaggcgccagcagctctaccagcagagacagcagaagctttttcaccagcgctcaccccagcagaccctgcagaatgagactgtaccagagcaacggcatggaagcctgcggcacacaccctacacctagactgtctagaggccctccactgcacaccagaaccatgagcctgagcaacatcctgatgaagttccggctgatgctgcagaagcagtgctgctacaacctcgtgatcaagcaccctctgatcttccggatcaacctgcggagacagggcaagaccaaagacggcgttgtgcagagcctgggcttcctgaaccagcagatcatcctgcagaaagagttcttcatctgcctgctgatgttcatcaagcggtggaagccagccgccacaaagacacctccaccactgattctgtggcctcaggccgctcctgtgcacaagaagagaggcctgttcagcctgttcttctcccactgcctgtgccaccagatgaagtgcctgaccgccgtggattgtctgcaggccttctgggacatgatgattcgcaagatccagaagcggcggagaaccgccaaccggctgaaaaagaaatacctggtgcagtgtaccaacctgagcgtgcccatgatgctgaccatcctgatctggaagcgggtgttcatcctcctgctgagcgacaagaagtgtctgagagtcagatgcggcggatggctgtgtggctggacacctagaggcaagaacaagaagcggagaaagctgcggcccaagcacctgaagaaaaccagcgccaaggtgtccgtgatcaccatgaagctctgggagaagcacttcaagggcctgaactggaacctggtcgtgtggattctgaacctgaagatgatgtggctcaagaagtccaccaagagcagacagagcagcccattcctggctcggagctggaataccatgcaatggaacaacaagaaaatggccatgaccgtgatcgctggcgcccaccactgtcagtacaagctgacctacaccaaagtgtggaagatgaattggaagaaaatgatgatcggctcccagcacctcctgtttagcccactggattcaagcccactgcagttgctgctgcaccctcacggcaagagatgcaacccttgctgcagactgacctggatgagcagagagtgggaaaagcggaagcagatcctcggcggaggcggcaagtacaaagagtacttcctgaagcggattctcatccggaaggctatgacagtgctggccggcgataagaaaggcctgggaagattcatgagatgcgtgcagagcgagacaaaggccgtgtctctgcagctgcctctcggccgaagaaagtccggcgtgatgaagtgttgggatctgtgccccagactggactttcaccccagatctagctctggcggcgagaagctgaagcactgtttcaaagcctggggcctgtgcttcttctacctgctgtacttcgagaagaaacggcccgagtggctgagcgttgaccctcctggatctgtctggattctgccctgcatggacctggacggaatgctgacagtgatcggccagggactcgtgggcatgacccctagagatctgggaacagtggctggcgccaccgcacagattcagaggcctatccaggtgcagacaggcggcagactgttcctgattcacctgagaaaggtggacacccaccatctgcaggtcgtgaccaagaccgtgacagccacaacagctgacggccagaggatgcggagactgaagtgcaaggcctgtcggctgagatgggccagacctgaacctgctgcacaggctcctccaaagagccactttccacctcatcctagcggcccctccagaacctctagcctgcagctcagacccattcctccacacctgagacacccactgctgctgaagggaaagaacagcccctgctgccaaaagaaactgcgggtgcagaaccagggccatctgctgatgatcctgctgcataacgccagacagcccagcaggcctaccggaagaacccctaccacaagactgatggcccctgtgggcagcgtgatgtcttgtagcctgctgacccagccatctcctgccagcgcatgtacaatgccaccactcctgcatccacagtgggccccacatagtgctggactgtctccaggcgcttgcagacctgcctgtacctgcatcagcatgaccaccatctccagagccacatggcggctgagaatcccaagcctgaggaagtaccggcagaacatcgagatcacccctcagcggtctaaggcccaggtttccgtgtacagcggcaatctgctgagcttctccagacggggcatgaagagtagcgtgcggctgaagaacagcatccctcacgtgccaaaagccaccgccgctcactctgtgacagtgaagctgcagtacctgtttttcctgaccgtgtgcggcttcgaccgggtgttcctggttaagatctgcaagaagaagctgctcctcaagctgctgagaggccccagacggaaagtgctgatggtgctttggctgcccgccaaccagagtctgcagaaaagccaggtgttccagtgggtgctgcggaccgaaacctacatggaaatgcactacggccatcaggcccctcaggtggccatgctgcctaaactgctgtgtagacagatgctccccactctgtccacactccagcagaggcatcctcagggaccttgtcctcctcctgtgacacctctgagagtgcagtctgtgctgctcctgggagtgcctcagacagccgcttttagcggccggattctgcaccagccagaaatggccgccatgagactgatgcccaagttcctgaactccaccaacagctggtggacagtggcccctagatgtcctagaagcgccgtggacattagccccggacctacatctcctagcctggcctcttgtgcctctgtggccattggaaaactggcactgctgggcgcatctgccccttgtggcgcagctggtgctagagaggctggaagatttgccgtgctgggcaccatggttatgaagggtgctgccgcagcctcctgtcagtctcctccatctccaagagagacaacccctagcagcgacgccaccagacggacaagacctattgccgctcagagcaaaaagaccatgactgccgccggactgacccctcggagaaacctgcagagaaatctgaaggtcctgggcgccaagaagatcaccttcctgagaaacagcagacgcgccacacctacctctaagggcagcctgagaagaaagtacctgagagtgaacatccgcaagctcatctggaccaagcagcggagcttcctgtctctgttccccaagctgagagccaccgagcagatgaccaatgtgggatgcctgctcaagaaaagcagccaattgcggcggagctggcgcaatgtgtcccggatcagcaacatggaacacaggctgaccatggacagcgccctgagcctgacaaagagagagggccctgagacaagcgagaagaagaggaagttgcctggctacccctacgatgtccctgactatgcgtcc

SEQ ID NO: 1194 - DNA, 4641 bp, Artificial Sequence
  Polynucleotide encoding the hTPA- and HA-extended poly-FSP polypeptide 4D
atggatgcaatgaagagagggctctgctgtgtgctgctgctgtgtggagcagtcttcgtttcgcccagccaggaaatccatgcccgaaacagaaagaccagaaaggccgccagagagaagcaccgcaagaccgacgacaagaagaagaagtccaccgaaaagaccaagaacgccaagaagatgcccttccagcagcggcctcctctgcagcctgttaacctggatctgcagcaccagcgcagacgcaaaaagaagaaagacaaggtcgaaatccggaatcggagccctaaggccaatagcaccgagtgtcagggcgagcacagcagagagcagaacctgctgaatctggtgcagctgaaccctcacagccctcaccacagaaaggacgaagaggaccaccagaagcggcaccaccaccacaatcaaaagaaaatgagcgtgcgggctagcgtgtccttctggacacttttgccaacaaccggcgtgcggacaagaggctctccactgagactgacactgtggcctccacgggttccaccttctccacctcttgctctgggccccagaatgcagctgtgtacccagctcgcccggttcttccctatcacacctcctgtgtggcacatcctgggacctcagagacacacacctcaggctcctctgaggctgtggtcttggtgcggcacaagccagacctacttcggcagcagaccatctccttgcctgagctggtccagcagaattgtggcccctggacacgccctgagctgtcggactagaagaagatggtctagcaagcggtggatcttctccaaccagctgaccgtgcagatgctgtgcctgccaatcacacacccattcgcctctcagcctctgggacaagagatgcccaacaacacccagatccggctgctgaagccctgcagagtgaacgccgtggaagaactgcacagcaggcggatgtctgtgcggatcgtgaagaactgggtgtcctgctgttacgtgcggctgtctgctgtgggcctgtctacttggagtgccctggacgaggaaaagaagaacggccggatcagcagcctgaaaaagaaagtgaatgcctgcagctccctgatcctgagcttccagcgcgtgaaaaccggcatggaaatcctgctgtggattctgctgaagatggaaattcagatcttcaagatttgcctgggcgagatgcagctctgcggccaggcctttggaagctttagcgccgatttcagcgcccctcagatcattaagaagatgaagaaacggatcatggtgcacgagctgaagaagaatctgctgctgcctatgtgctccagcctggctctgccaacaggcctgacatctctgatcctgcctagcagcgatctggccgtgctgatctctagctccaccagccactttctgatgcggagccctgtgctgccaagcagcagactgacttgtgcctctccacagctgccccggatgtggacttggtctagctggctgaagaacgagggcaacaaccactggcctagagtggaaatgcctaccggctggctgctcgtcggctacaacaccagaaacacagcccagaatcctcggctgcagcagcacctgaaacactggcagcagtgcaccagagccagatggtgtcaagagccctgtcagaccctgaccttcttccatttcttcttctttttcaaaacggtgtccctgtgttgccccggctggtctaaaggacaacctcctccacctggcctgaagccttctagcctggcttctcaggtggccagaaccacaggcgtgtaccagcacgtgtggctgatctgtttcgtgtttttcgtgtgtgtggaaaccggcttctgtcacgtggcccaagtgggactcgagagactggtgtctctgtccggcatcaccgacgtgaaccattgggcccagcctaagccatctcctagcaaaggcaccggcatgaacagacccatcggcctgagagttggcaaaggcgtgtgggccagactgatcctggccatgacactgaccctgaacggcatggccaagaagtcccagcagcctctgcaggtcgtgctgagactgggaaacctgcctccattcttcagaggcagcgaggtgccctttcctagaccttgtcggaccaagcctgcctgcacaagcaaggcctggactcccagaaaactcgtggggagagccgtgcggagaaagggatctccactctgggattgctccaccacaacaggcacacaccacggatgcctgtgggagatcccatctgtgaccctgctggcccatcctagaaccgcctctatcaccctgcctaccacaagcctgaagggctccagaaccagctgctgccctagatctcaccccagactgcctaggaccaaatggcccctgcagtgtctgctgcacagcctgggaacaaccggaacactcgtttgggaaaggggcgtcctgcagatgagatccctcgaagcccattgtccactgcagaccttccatctgcaccactgcaggacccagcctagctcttgtcctcctgcctggattctgtaccaaggacagtggagcggagccgtcgtgggacttagacctgtggctcaccatctgcctagacctatccagggcctgcactgtccacaggcacctcatcaacctgctctgagctggggaaaatggcccgtgggaatgacaggccctgccagatgttgcagatggcccagacggtgccagaagaaggttccatcagcctctccatggggcctcgtgctcaaaaagaaccggaaacagatgctgaaccagaagtgtctggccccttttagagagagcaccctgggcaatttctggatgaagctgctccagctgcctgtcgtgatcaacctgaagagactgcagaagttcaacctgcacctgtgctactaccacagccagagcaacagaaacaagagccgccagatggaatccctgggcatgaagttgcagtcccagaaatcccagcaccactgtgccctgcggaagatcgagtgggccacaaagttgtctctcggcggaaaagccggaccacaggctcaagagaaggccacctctcggattctgaacctgcaagtgctcaagaagatcctgcggagctttatgaagctgtaccactctctggtcatgtgcctgcggctgaggaccaagctggaaaaggctctgagcgccctgttcatctggccccagcacagctacaagcccctgttctttcacggcgacctgtgcgagtggggaggccaggctcatagacagcggaactggctgaaaaactggaagcggttcaagcttaaaaagaagtacatccagaagaagaagcagaagtctaacaagatcatctgcaagggccaccgcatcaccatcatctgtatcaagaatatgttcctgcagcgcaagggcttcctgaacctgagccacgtggaaaagttctgtagaggcggccctagcgccagcgatagatgctgttcttgtagccccagcggcttcagtgccggcagaggaagatgtcctgttcagggctgtctgaggccccacagagttcaactgctgagaagatggggccctggctctcctgctggacagaggctgtctaagggctttcagctgctccgttggtggggaccaggatctcctgctcctgagcctagaaagggcccatttccaccacctgatcctccatggcctgtgaccgctgtgacagtgatggctggatctgtgcctagtgctcagtctgtggacgccctggaatctcctggacctctggctctcgaaggacctagcagccctagaaacctgctttggagagagatgagcatctttctgcccggcatcttcaccgccaagaaaagccccaccagcttttgctgcaatatcctgaacagcctgccaagctctatggaaatcgccgtgctgcaagaggacagcaaaaagatgacccagaagggccaagccttcggctccctgtgtcagcttgtgtccgctgacttctctgcccctcaagtgacccggctgcggagcctgaatcatctgctgatcacctacacaccccacatctgcagacacaccctgctgacccctgacaccagatggatctttagcaatcagctgcagacagtccagatgctctgtctgcctccactgaagcagggcgagagaatcatttggcccctcggcggctttcagatccccaacttcttttggagcctcggcatcggacacactggcgcctggtggcatactggaaggcggagaagagaatggggcggcagcaccgtgtctagaagccctctgtggatcagctccatgatctacctgagaggcatggccttcgccagcgacagcagcatcagaaccaccagagtgtcctggtgcagaagatgcggcgccaaaagcgctgccgccagctctattgaagctctgaccgctctgtttacctgccggaccgccagcatcagcgtgaacatcagcaccctgatgtccatcctggaagcacttaagaagaaacccagagacatctgccgcatcagctgccggtgtagacgcgagtacagagtgactatgggctacccctacgatgtccctgactatgcgtcc

SEQ ID NO: 1195 - DNA, 5250 bp, Artificial Sequence
  Polynucleotide encoding the hINV- and HA-extended poly-FSP polypeptide 1C
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgagcaccagacgggaaatgccttctcaggccacaccttctccacctggaccttggagagccgctctgggcaaagaagtgaagcggagccagagcaagctgcggctgagaaacacaagccccaccgagatccaattgaccatgaacgacagcaagcacaagctggaaagccccgctctgaaacaggtgtcccctgcctctccacctacacagcagcctcagacaccccaggatagcagacaggtgctggccgcttcttctcctggacatcctcttggccctggcgactgccctagaacaatggctggaccttctgcctctctgcacccagcatctggcagagccagcagaaagacctggcagagaaggctgagagcctgtagagctggtggacctgctggatgggctagacaggccatgacactgaaggccctggtcaagacctggacacagttcagaaactaccccagagtcggagccggaacaggcggaggacctgcttgtgttcctgtggccgaagcttctactggcgcctggacagctgaaggcgctgccggaacaagatgcagagcttctagagccccttgcagacagctgcctgccagctctcctaccaagtgcgagatctgcgtgaagagaaggcggcggagaaagcggagcagccagtctagatctcccgtgcctaagaaacgcgagcggatgatgctgcctgtgcgggccagaacagctagatctgctctgccacaaggcagagcccctctggaaggaatgcttctgcctagagcactgcccagcctgctgagcagaatgccagccagaagagagagccggttttggctggcactgcaggctctgggactcagacctcctcatctgcctagctgtcaccctctgcctcaactgcttggacctcctccacctcatcaggcccctttcgacaagaaaggcttcgtgatcctgagcaagggcaagaagcgccggaaagaaatccggcggatgaccagacggaccatgaccaccaccaaaatgatgatgatgcggcggaccaagcggcggaggcgaaaacgtagaagaatgaccatgatgacccgcagaaccctgctgaccaagaaaacctgtctgacccctagaaccagcgccgccacaaaagctctgcccagacagacaatcagccagcggaggcctatccagacacctcctggaacaagcctggccatctggggcagactgcctctcagaccacagagaggacctcggcctctgcatagatggctgcagcagacaacaggctgctcccagagaagaatcgccaagaagcggatcaagctgaggcggaacacactggccatccggtttatctctgcccctcagcctagcagcagcaccgttacagctgctcctagcggccagtacttcagcagcttcttctacaccagcgaccggaccaagtgtgaaatctgtgtcaagaacaccgccatcctggctatcaccctgatcacccctcaggaccctcacctggaccctgtgtgtcacccacatagaaggcctggctggaagggccaccacagagtggtgtttagccaccatccaagcggctccaccaagagccattggcagcagagagaaagaggcggaggccgcagagaaaaaaagggctgcagagagatgcccagcagctggtctagctctggcagaaccgccgacaaaaagaacgtgcggagcagaaccagactgaccctgacaggcacaagaagcagcggcacaagagcctctccaagcgccgtgtgtctgtgctgttggacatgcccctccagaagcttccctgccgcatctccatctggactgagagcacctgttggagcccaggctcctcctgaagtgacactgagagccagctgtgcctctagcgcctctaaagcctgtgctggactttggccttggggagcccaagtgcggaacaaagtgcggcagaacttcaagcggaacctggccaaaaagaccctgactaacgccctgcggagtatgcccaagagcagaaaccaggtgctgttcagacggaatctgaccccaagccagctgagaactctggcccctccttacatgctgctgccccagtctctgtctcagagcctgtccagaaagcagatccccagccaatcaatgctcgtgaccgccttcttcctgctcgacatcatcctgagaagcctgctgtactcccggatgtgcctggtgcagatccctacacacacctgggagcccgactacttcgtgtccctgcctatgatgttcagctgggccactcagagctttccagtgggagccgtgttcctgaccagacctgccattccttgctgcagctgtaccagccacagcaacccttggagccagtccttcaagaagaagaagcccctgacattcagccccagcgtgccaatgtctctggcctgtagcatcaccgtgtccttcgtgggccagatcagcacactggtgctggacgtgtcctccatctctcactggcgcaagcgcaagagagagaagcggtcccagaagtcccggcagaaccatctgcagctgaagtcctgcagacggaagatcagcaactggtccaagctgagatccccgtggatcttctaccctcggctgaaaaccttcggcgtgccactgggctctatcctgtgtctggcaggctccctgagcacgatgatgatcattagcaccaccagacaagagtgtggcagacgggcctccgtgccttgtagacctatgatcggcagcgctagacccggaccttggcggacatctgctatgccatctgccatgggagtcgccctgcctaccagctgtgaaagcggaagatctcctcctgccaccggcggaagaatgcctggatctcagtctatcatgatgagctggatgcctccactggctccctgtgccgcttgtccttgttctcctgctcctacactgtgccctgctcatcctgcaagagcccctacagccgtgcctgcctttacacctctgtctgctcaccctgtgccagtgctgtctggatgtcacctggccgtgcgcacctctatgctgacactgctgcccatgagacaccctcacagaagcccacctacaagctgccctccactgctggaagctttcccactgccaagggccagcctgagagctaccgtgcctagacacagctctgtgctggccactggactgcatctgcatcggcagattagcctgcctctgaggggcttcctgctgcatcaacctctgcctggacaacacctgtggctgtcccacagactgaggctgagactgccaagaacaggcgagaagaacgacctccagctgttcgtgatgagcgacaccacatacaagatctactggacagtgatcctgctgaacccctgcggcaacctgcacctgaaaaccacatctctgcggagagccagacctacctcctgcagcacatgcagaatgtggtggctgaagctggccccactgcaagtgaccacaacactgaagctgatcctggtcatgctggaaatcgtgaccgaagaggccaagaaatccatgaagagatcccggcggagcaagatcgaggcctctcctatcggctccatcatgaagaagaaagacagcaccatcttcatcaaccagcagctcaagtggacccctcacatcctgaagtctgccagcgtgtccaagaagagactgcccaagctgaacggcatctgggaagtgatgccccggacactggaaggctgcatcagcgtgaaggaccaccggacaagccagaaccacagcaagtgcatcaccgagtgtgtgcggacagccctgaaccagagaaaggtggtcaagaaccccagccagccagtgccactgagaaacgacggcatcaccaacggcaacgactccaccagatcctgctccatcagcctgaagaaaagcctggaaaagatgcccctgatgaacgccaagaaaatggaagatatgatctgggagagcaacatgggcggcaaccggtccatctgcctgacaagactgccctgcaaagtgaccgagtccagccaaagaccacctcggagcattctgtccctggcctctagagccggacagtttcccgtttggcggagaaccagcagaggcatgtccctgcagtggaagtccggcaatgcctgcacacctctgaggtgccctagcagaagccctgccacatttctgaccgcactgaacggctggcacagatctggacttagggctcagcaacctagcctgccaggaccttgtgctagcctgctgtctacactgagccagcctccaccacaggctccaagccaagtttggacagccgccacactgagatgtcccgctgttcctgcagctgcttgccctcctatcgtgttctttctggccccatacttccccacaccactgagcatcagcagacccacctctcgggccagacagtcttgttgtctccccggactgacacaccctgctcaccagcctcttggctctatgggctacccctacgatgtccctgactatgcgtcc

SEQ ID NO: 1196 - DNA, 5232 bp, Artificial Sequence
  Polynucleotide encoding the hINV - and HA-extended poly-FSP polypeptide 2C
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgcggcagatcaacagacggaagctgcagagaaagaagcgccggaagaagagagaggaccactgcggactgcgggccagaaaccggaacatgaagaaaaccatgagccacctgatcgcccatcaggccctgaagatgtctggcctgagactgtttcaccccagactgctgacacggaagaagcctggcaagaaccctcggagaaagacctggaagatgcggaagaagtacgcccagaagcctagccagaagaaccacctgtacggcaagggcctgacacaccctgtgcctctgaagagaaccctgcagaacaagcggaacaagaacatcaagcgcgtgaaccagaagaagggcaacatcaagagaaagagcatcctgctgcacctcatcgtgctgaacagccccgagagcaacctgcaggctcatcctcaagttccagcactggctcctcaggcttggtggcctgctagaagaggccctctgacaagcgctccatctgctcagcagagcctgaccttcctgcctagcagatttccttggggccctcctccactgcactggaactctgcctacctgggcagaacactgctcgtgacctgcatcctgtaccacagatggatcgtgaccagcatgtgccagagccagagatggctgaccagcaccacctctagaagcagcgccctgatgtggacccagtggtctagcgtgacaagcctggaatggacagcccaagagaggggctgtagcagctggctgatgaagcagacctggatgaagtcttggagcctgcgggaccccagctacagatccatcctggaatacgtgtccaccagagtgctgtggatgcccacatctacagtgggagccctgagagccacagctcctgcaacagctgctccacaggctcagacccctcattggagagccgccacaacaagcagcatgagcagcagccctagagccgagcctacaagctctagctcttgggccacctgttggcccagatgttgcagctccagctgttactggtccctgtcctcttggcctcctgctggtgctgccgaggccacaaataccaggaccagaagcagagagtcccagcggggcagaatgctgacttggagaagcagcctgtggctgcagggcaccagatgttttacaggcgtgcggacctccagcagacacccttcttggccttggaccagatgcctgagaatgcggcctcctagaagcaacagccggaaaaagctgctcgaggacatgaagcaaaatggcttcacccggtacaagaaacggggcgtgatagcctggcggagagccactttcctgctggccctttgggagtgcagtctgccccaagctagactgtgcctgatcgtgtctaggaccctgctgctggtccagagcagatgcagcctgatggaacagatccctcacctgaagtcctggtggtgtacaagaggcggcggaaagcggaagaaaaagatgtgcaaggtgtccggcggctgcaccgcctgtgttgaaagatgtccttggaagggcatctgctggaagtggcctgtgacagtggccgctctgatcctgattcagcacggcggcatcttcaccttccggttctgggtcgagaagctgtcctggaacatctgcaagaatctgtccctgtacctggacaagttcgtgcagcggctgctgtacgtgtacatcatcgagacaaacgtgttcgtcctgaacctgttccacgtgccagtgaatcagatcttcatgatggccttctacctgaagtacaccgagaaggcctgggtcatggaactggaatggctcattcagcagcagtgctaccagttgctgctggctcatatgtacggcttcagcacctacggcacccagaaaggcgagtgcgtgtgtctgcagtgtctgagcggcagctccctgttcatcctgaagcagccactggacctgaagatcagcaagaccttcatgagcagatcccacctggatttcagcccctattggatgaagaaagtgaaggcctctccacagatcatgcagcggatgagcgccgtgaacttcgagacaatcaggcggaagtggcagatccggcacgtgctgaagaacctgcctctggaaaacacacagatccccaggacaagccctctgtggaagatcacaatggtgctgacataccccaactgcgtggtgcatgtgctgatgttcgtgctgttcaaggccgaccagagcgagtctagcctgagcagcggaatctaccctcctagcacctgtagcctgccttgccggggcattagaatgtgcgccctgtctcaccctagcttctacatcagcagcaccgtgtgctttctgagcaagcactgcatgaccgcctgcaccagagagaagatcatcaaccccaccatcagctgcccctttcagagccccacaaagagactgggccacagagagggcagcgagagcgataatctgggcctgctgtactcctttcctccttggctgcccatgagatccctgggcgaaccttggagagctggctttcagtggggagagtccccttggcaagtgatggctagcctgaccggcaacagcgtgatcgtgcacaagatcgtgctggtgtttctgaagtctctgagcagctacaactgcgagcggcggatctctggcatccagaagagagccatcgagttcgccgtcctgaagctgctgaacatggacctggctagccctcagattatgcagagaaccagcgccgaccggttccggatgaagcggagaatgcagaacctggataacctgggcgtgccctggccattgcttccaggtgctgctcctccacatagactgctgggcccctctagatggattctgtttcatgtgcggaacatcgtgtacggcatccaagtgatgctgtgccggcggagaaacagcagaaagcagagtcaggtgcagctggccattcaggtcctgctcgtggacaagcacaagtactttctgttcggcccctatcctatcagcgagggactgaccatgaccaccggccggaacatcaacagcaactccctgatgaccaactgcctgttcagccccatcttcctgtgccaccacgccatcatgcaccggaagatgacaagcccacacttcagactgttctccagcaagatcccacatcctcaggtgccaagtgtggtggccctgtgcaagttcctggccaatggcctgtggttcaacctgatctttcagaaaaagggccacatgatctttagccccaagttcttcctgacctttagccagcggaccctggaatccgccggactgtttccatggctgcacacccagtgccggaacaaaaagaccaagctgtggttttccctgatcaacatccaccaccgcaagaatcctctgctgcctatgagaatgagcagaacacctcctcggagagtgtgcggatctccacctctgcatctgtgccaacctctgagaggcggcaagaagagaagcaagttcgccttctggaagcctcctagccagggcatcagctcttgtctgatgacaggctgttggggctcctgtggcagagcttgttcttgcggaagaggctgcggtacacccagaggcgactggaaaagacacccacctcgcagagagctgagcctggaaccatggattccttatctgcaccagcaaaagacccagcggaagcggatgaagaccggcgccattcaagagaagggcgctatccaagaaaaaggcgcaatgaccaagcggatctgcgtggtcaatttcgaggcctgcagagagatggaaagcctgagcgcccctgagaagattaccctgttcgaagcccacatggcccggtgcacctccatcaatgtgctgtgtgtccgggccagcctgattgagaagctgatgaaagaaaagcgcaagatgaagcgcaaccaggtggcatcccctcaaatcatgcaacggctgttcatcaagggctaccagaacaaccacttcacgttccacctccaaaactttgccttcttcagctccttcggcaacaacaagtatatcaacattctcacccgggccttcatccacacacctagaagccctggctgttccgtgtacgccaatatgtgctggcggaagatgcagtccctgaatcaccccagcagactgaccaactgtcaccccgcttggctgagccccattagtgcttgtcctaggctgctgccctatccttttcacgtgctggcactggaagtgacctttccacctggcacagccatgcctcagatgcaattgcaggcactggctatgtgggagaaaggctgggacaagcaagagaagaaatcccgcaagctgatgtcctcctgcctggaaaaaaaggctacctggatgcggagaacccctggcacaagcctgcagtgttacctgaacacacacccctgcaccatgctgctgcctcagggaatcccatctctgaacgcccagtggatgttcctgcggatcggctacccctacgatgtccctgactatgcgtcc

SEQ ID NO: 1197 - DNA, 5247 bp, Artificial Sequence
  Polynucleotide encoding the hINV - and HA-extended poly-FSP polypeptide 3C
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgcctattcctccacacctgagacaccctctgctgctgaagaacaagaagcggagaaagctgcggcccaagagcagaaagaagggccacaccaagaaccggcggaaggccaagagaaagccccagatcagaaacagccgcagagccacacctaccagcaagggcagcctgagaagaaagtacctgagagtgggagccgccgctgctagctgtcaatctcctccatctcctagagagacaacccctagcagcgacgccaccagaagaaccagacctatcgccgctcagagcaagaaaaccatgacagccgccggactgacccctagccagaagaaagatcctgccggcaagctgaagaaacaggtgtccgtgtacagcggcaacctgctgagcttctctcggagaggcatgaagtctagcgtgcgcctgaagaactgcaccaacctgagcgtgcccatgatgctgaccatcctgatctggaagcgggtgttcatcctgctgctgtccgacaagaaatctatccctcacgtgcccaaggccaccgccgctcattctgtgacagtgaagctgcagagccggcggaacagacggtacagaaagatctatggcgagctgaagatgtccctgcaggccagcaatggcatggaagcctgtggcacacaccccacacctagactgtccgtgtccgtgatcaccatgaagctgtgggagaagcacttcaagggcctgaactggaacctggtcgtgtggattctgaacctgaagatgatgctcaagaagaagtatctggtccagcgcgagtgggagaaacggaagcagattcttggcggcggaggcaagtacaaagagtacttcctgaagagaatcctcatccgcaaggccatgacagtgctggccggcgataagaaaggcctgggcagattcatgagatgcgtgcagagcgagacaaaggccgtcagtctgcagctgcctctgggcagaatggacctggatggaatgctgaccgtgatcggccagggactcgtgggcatgacacctagagatctgggaacagtggctggcgccaccgcacagattcagaggcctattcaggtgcagacaggcggcagactgagaggccctagaagaaaggtgctgatggtgctgtggctgcccgccaatcagagcctgcagaaaagccaggtgttccagtgggtgctgagaaccgagctgcccctgacctttagcaccctgctgtgggacagcagacacgacctgcctagaatgctgcccatcagcagccctctgcacagaccccagatgcctttctggacctgcacctttcctgccaccacatggggcacatgggagacaccttctacatggggctggcggacctttgccagacagccttctagacccaccggcagaacccctaccaccagactgatggctccagtgggcagcgtgatgagctgtagcctgctgacacagccatctccagccagcgcctgtacaatgcctccactgctgcatcctcagtgggcccctcattctgctggactttctccaggcgcttgcagacctgcctgtacctgcatcagcatgaccacaatcagcagggccacctggcgcagaaacctgcagagaaacctgaaagtgctgcggctgagaatccccagcctgcggaagtacagacagcagaacacccggtccaccaacctcgagaagaacccatctctgaagaagcagagccagaggcggggcaagctgtctctgaccacactgagcttcgtgctgatcgaggaactgctgaaaaagagcagccagctgcggagaagctggcggaacgtgtccagaatcagcaacatccggaagctgatttggaccaagcagcggagcttcctgtctctgttccccaagctgagagccaccgagcagatgaccaatgtgggctgtagactggattttcaccccagaagcagctccggcgacagagtgttcctggtcaagatccagagcagcccattcctggccagatcctggaataccatgcagtggaacaacaagaaaatggccatgactgtgatcgctggcgcccaccactgtcagtacaagctgacctacaccaaagtgtggaagatgaattggaagaaaatgatgatcggcagccagcacctcctgttctccccactggatagctctccactccagctgctgctgcacccacacggcaagagatgcaacccctgttgtcggctgacatggatgagccacctgaatcggaagctgcacctcaccaggtcctgcctgatcgacctgaccatgatgatgagccagaaactgtggaagaatcagcggaagcgcatccctctgccttctccaagacagcatctgctgcctcagtatcctctgcaccctcctccaccttgtctgctgcttctccaccatagacaccacctggcattcctcgagatggcctgtagctctcagcacacccacagcatcaagatctggatcagcttcagccacgagacaatgagcctgtccaacatcctgatgaagttccggctgaccaccaccacaagcagccccagaagaagccctgctctgcgagctagaggcggcacaacaatcggcgaagtgaccagcagcctgttctttagccactgcctgtgcgtggcccctagatgtcctagatctgccgtggacatcagccccggacctacatctccttctctggcctcttgtgcctctgtggccattggaaagctggcactgcttggcgcctctgctccttgtggtgctgctggcgctagagaggccggaagatttgctgtgctgggcaccatggtcatgaagaacatggaacacagactgaccatggacagcgccctgagcctgacaaagagagagggccctgaaacaggccccgtgtactacgtgtgcaaccggatgaatgtgtccagcgtgctgaagcctttcctgttcaccgtgcctatcgaggacatgagagagtgcaccctgggacgcaacagaatgaatgtctcttccgtgctgaaaccctgtctgatccccgtgccaatctgcaagaagaaactgctgctcaagctgctgaggggcgcctccagctctaccagcagagatagcagaagctttttcaccagcgctcaccccagcagaccctgcaggatgagactgtaccagatgctgcagaagcagtgctgctacaacctcgtgatcaagcaccctctgatcttccggatcaacctgcggagacagggcaagaccaaagacggcgttgtgcagagcctgggcttcctgaaccagcagatcatcctccagaaagagttcttcatctgcctgctgatgttcatcaagcggtggaagccagccgccaccaagaagggcaagaacagcccctgctgccagaaaaaactgcgggtgcagaaccagggccatctgctgatgattctgctgcacaacagaggcccacctctgcataccagattcgagaaaaagcggcccgagtggctgagcagaaaatccggcgtgatgaagtgctgggatctgtgccctgccttcagcggcaggattctgcaccagccagaaatggccgccatgagactgatgcccaagttcctgaactccaccaacagctggtggacagtgcacaagaagagaggcctgttccaccagatgaagtgtctgaccgccgtggactgtctgcaggccttctgggatatgagcgagaagaaacgcaagctgcctatgattcgcaaaatccagaagcggcggagaaccgccaaccggaacatcgagatcacccctcagagaagcaaagcccacctgaagaaaacctccgccaagggcgccaagaaaatcaccttcctgtgcctgagagtcagatgcggaggctggctgtgtggctggacaccaagaggatggctgaagaagtccaccaagtccagactgtgcttcttctacctgctgtactacctgtttttcctgaccgtgtgcggcttcacccctccaccacttattctgtggcctcaggcagcccctggcgagaagctgaagcactgttttaaagcctggggcgtcgaccctcctggcagcgtttggattctgccctgcttcctgattcacctgagaaaggtggacacccaccacctccaggtggtcaccaaaacagtgaccgccacaacagccgacggccagaggatgagaaggctgaagtgcaaggcctgccggctgagatgggctagacctgaacctgcagctcaggcccctcctaagagccactttccacctcatcctagcggcccctccagaaccagctctctgcaattgagaacctacatggaaatgcactacggccatcaggccccacaggtggcaatgctgcctaaactgctgtgtcggcagatgctccccactctgtctaccctgcagcagagacatcctcagggcccatgtcctcctccagtgacacctctgagagtgcagtctgtgctgctgctcggagtgcctcaaacagctggctacccctacgatgtccctgactatgcgtcc

SEQ ID NO: 1198 - DNA, 5250 bp, Artificial Sequence
  Polynucleotide encoding the hINV - and HA-extended poly-FSP polypeptide 4C
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatggacagcaagaagatgacccagaagaaccgcaagacccggaaggccgccagagagaagcacagaaagaccgacaacctggacctgcagcaccagcgcagacgcaaaaagaagaaggacaaggtcgagatccggaatcggagccctaaggccaatagcaccgagtgtcagggcgagcacagcagagagcagaacctgctgaacctggtgcaattgaaccctcacagccctcaccaccggaaggacgaggaagatcaccagaagagacaccaccaccacaatcaaaagaagatgtccgtcaacgagggcaacaaccactggcctagagtggaaatgcctaccggctggctgctcgtgggctacaacaccagaaacacagcccagaatcctcggctgcagcagcacctgaaacactggcagcagtgcaccagagccagatggtgtcaagagccctgtcagaccctgaccttcttccacttcttcttctttttcaaaacggtgtccctgtgctgccccggctggtctaaaggacaacctcctccacctggcctgaagccttctagcctggcttctcaggtggccagaaccacaggcgtgtaccagcacgtgtggctgatctgcttcgtgtttttcgtgtgcgtggaaaccggcttctgtcacgtggcccaagtgggactcgagagactcgttagcctgagcggcatcaccgacgtgaaccattgggcccagcctaagccatctcctagcaaaggcaccggcatgaacagacccatcggcctgagagttggcaaaggcgtgtgggctagactgtggctgaagaactggaagcggttcaagctcaaaaagaaatacacaggcatggaaatcctgctgtggattctgctgaagatggaaattcagatcttcaagatttgcctgggcgagatgcagctgtgcctcaagaagaaagtcaacgcctgcagcaacgccaagaaaatgcccttccagtgccggtgcagacgcgagtacagagtgaccatgattcagaagaagaaacagaagtccccgctgttcttccacggcgacctgtgcagaccttctccttgcctgtcttggagcagcaggatcgtggctcctggacacgccctgagctgtcggactcgtagaagatggtccagcaagatggccaagaagtcccagcagcctctgtgtagaggcggcccttctgccagcgatagatgctgtagctgtagccccagcggctttagcgctggaagaggcagatgtcctgtgcagggatgtctgaggccacacagagttcagctgctgagaagatggggccctggatctcctgctggccagagactgtctaagggcttccaactgctgcgttggtggggaccaggatctccagctcctgagcctagaaagggcccatttccaccacctgatcctccatggcctgtgaccgctgtgacagtgatggctggctctgtgcctagcgctcagtctgtggatgctctggaatcccctggacctctggctctcgaaggccctagcagccctagaaacctgctctggcgggaaatgagcatcttcctgcctggcatcttcaacctgcacctgtgctactaccacagccagagcaaccggaacaagagccggcagatggaatccctgggcatgaagctgcagatcacacacccattcgccagccagccactgggccaagagatgcccaacaacacccagatcagactgctgaagcccggccaggcctttggcagcttttccgccgatttttcagcccctcagcaggcccctctgagactgtggtcttggtgcggcacaagccagacctacttcggctctatcgaagccctgacagccctgttcacctgtagaaccgccagcatcagcgtgaacatcagcaccctgatgagcatcctggaagccatcctggccatgacactgaccctgaatggcagccctctgtgggactgcagcacaacaacaggcacacaccacggctgcctgtgggagatcccttctgttaccctgctggctaccgccaaaaagagccctaccagcttctgctgtcagcggcctcctctgcagccagtggaagagaagaagaacggccggatcagcagcgtgccaccttctccacctcttgctctgggccctagaatgcagctctgcacccagctggcccggttcttccctattacacctcctgtgtggcacatcctgggacctcagagacacacccctctgctgacccctgacaccagatggatcttctccaaccagctgcagaccgtgcagatgctgtgtctgcctccactgaagcagggcgagagaatcatctggcctctcggcggctttcagatccccaacttcttttggagcctcggcatcggacacactggcgcctggtggcatactggaaggcggagaagagaatggggcggcagcaccgtgtctagaagcccactgtggatcagctccatgatctacctgagaggcatggccttcgcctccgacagcagcatcagaaccaccagagtgtcctggtgtcggagatgtggcgccaaaagcgccgcagccagcagcgacaagaagaagaaaagcaccgaaaagaccaagaacaagatcatctgcaagggccacagaatcacccaggtggtgctgagactgggcaacctgcctccattcttcagaggcagcgaggtgccctttcctagaccttgccggaccaagtgccagaagaaggttccaagcgcctctccttggggactgcacccaagaacagcctccatcacactgcctaccaccagcctgaagggcagcagaacaagctgctgccccagatctcaccccagactgcccagaacaaagtggcctctgcagtgcctgctgcacagcctgggaacaactggaacactcgtgtgggaaaggggcgtgctgcagatgagaagtctggaagctcactgccctctgcagacattccacctccaccactgcagaacccagcctagctcttgtcctccagcctggattctgtaccaaggacagtggagcggagccgtcgtgggacttagacctgtggctcaccatctgccaagacctatccaggggctgcactgtcctcaggctcctcatcaaccagctctgtcctggggaaagtggcccgtgggaatgacaggacccgccagatgttgccggtggcctagaagaatgtgtagctctctggccctgccaaccggcctgacatctctgatcctgcctagcagtgatctggccgtgctgatctctagctccaccagccactttctgatgcggagcccagtgctgccaagcagcagactgacatgtgcctctccacagctgcctcggatgtggacatggtctagctggctgaaagagtggggaggacaggcccacagacagcggaactgtagagtgaacgccgttgaggaactgcacagcaggcggatgtctgtgcggatcgtgaagaattgggtgtcctgctgttacgtgcggctgagtgcagtgggactgtctacttggagcgccctggattccctgatcctgtccttccagagagtgaaaaccagccggatactgaacctccaggtgctgaagaagatcctgcggagctttatgaagctgtaccactctctcgtgatgtgcctgcggctgcggaccaagctggaaaaagctctgagcgctctgtttatctggccccagcacagctacaaaggccaggcattcggaagcctgtgccagctggtgtctgccgatttcagcgcccctcaagtgaccagactgcggagcctgaaccatctgctgattcggtggatctttagcaatcagctgacagtccaaatgctctgcctgccgatcatcaagaaaatgaagaaacggatcatggtgcacgtcttgaagaagaatcggaagcagattatctgtatcaagaatatgttcctgcagcggaagggattcctgaacctgagccacgtggaaaagttcagagagagcaccctgggcaatttctggatgaagctcctgcagctgccaccagcttgcacctctaaggcctggacacccagaaagcttgtggggagagccgtgcggagaaagggcgtcgtgatcaacctgaagagactgcagaaattccgggctagcgtgtccttctggactctgctgcctacaacaggcgtgcggacaagaggctctccactgagactgactctgtggcctccaagaagccagaaaagccagcaccactgcgccctgagaaagatcgagtgggccacaaagctgtccctcggcggcaaagcaggaccacaggctcaagagaaggccaacatcctgaacagcctgccttcctctatggaaatcgccgtgctgcaagaaatgctgaaccagaagtgtctggcccctttcgagcttaagaagaacctcctgctgccaacctacacaccccacatctgtcggcacacccttaaaaagaagcccagagacatctgcagaatcagcggctacccctacgatgtccctgactatgcgtcc

SEQ ID NO: 1199 - DNA, 5250 bp, Artificial Sequence
  Polynucleotide encoding the hINV- and HA-extended poly-FSP polypeptide 1D
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatggccgacaagaaaaacgtgcggagcgctagttctcctggacatcctcttggccccagaagaatgaccagacggaccatgaccaccaccaaaatgatgatgatgcggcggaccaagcggcggagaagaaaaagacgccggatgaccatgatgaccagaagaaccctgctgaccaagaaaacctgtctgacccctagaaccagcgccgccacaaaagctctgcccagacagacaatcagccagcggaggcctatccagacacctcctggaacaagcctggccatctggggcagaagaagcaagatcgaggcctctcctatcggcagcatcacccctctgagcatcagcagacctaccagcagagccagacagagctgttgcctgcctggactgacacaccctgctcatcagcctctgggctctatggttggagctggaacaggcggaggacctgcttgtgtgcctgtggccgaagcttctacaggcgcttggacagctgaaggcgctgccggcacaagatgtagagccagcagagccccttgcagacagctgcctgcttctagccctaccaagtgcgagatctgcgtgaagagaagaaggcggcgcaagcggagcagccagtctagatctcccgtgcctaagaaacgcgagcggatgatgctccctgtgcgggccagaacagctagatctgctctgccacaaggcagggctcctctggaaggaatgcttctgcctagagcactgcccagcctgctgagcagaatgcctgccagaagagagagcagattctggctggccctgcaggcccttggactcagacctcctcatctgcctagctgtcaccctctgcctcaactgcttggacctcctccacctcatcaggcccctggcgagaaaaacgacctgcagctgttcgtgatgagcgacaccacctacaagatctactggaccgtgatcctgctgaacccctgcggcaacctgcacctgaaaaccaccagcctgaacgccaagaaaatggaagatatgatctgggagagcaaccagcagctgaagtggacccctcacatcctgaagtccgcctctatcgccaagaagcggatcaagctgcggcggaacagcaccagacgggaaatgccttctcaggccacaccttctccacctggaccttggagagccgctctgggcaaagaagtgaagcggagccagagcaagctgagactgagaaacacaagccccttcgacaaaaagggctttgtgatcctgagcaacatgggcggcaaccggtctatctgcctgaccatcgtgttctttctggccccttacttccccatgcctagcagctggtctagcagcggcagaaccagactgcctctgaggccacagagaggccctagacctctgcatagatggctgcagcagaccaccggctgctctcagagaagaggcgactgcccaagaaccatggccggaccatctgcttctctgcaccctgcatctggcagagcctccagaaagacctggcagagaaggctgagagcctgtagagcaggcggacctgctggatgggctagacaggccagaaaacgcaagagagagaagcggtcccagaagtccagacagaaccatctgcagctgaaaagctgcagacggaagatcagcaactggtctaagctgcggagcccctggatcttcgaggccaaaaagagcatgaagagatcccagcggcctcctcggagcatcctgagcctgttcaagaagaagaagcccctgacattcagccccagcgtgtccaagaagaggctgcctaagctgaagggcaagaaacgccggaaagaaatccagcggaaggtggtcaagaaccccagccagcctgtgccactgagaaatgacggcatcaccaacggcaacgacagcacccggtcttgcagcatcagcctgaagaaaagcctggaaaagatgcccctgatgcggagcctgctgtactccagaatgtgcctggtgcagatccccacacacacctgggagcccgactactttgtgtccctgcctatgatgttcagctgggccacacagagctttccagtgggcgccgtgtttctgaccagacctgccattccttgctgtagctgtaccagccactccaatccttggagccagtccacactggccatccggtttatctctgcccctcagccaagcagcagcaccgttacagctgctcctagcggccagtattttgccctgcggagtatgcccaagagccggaaccaggtgctgtttcggagaaatctgaccccaagccagctgcggacactggcccctccatatatgctgctgcctcagtctctgtcccagagcctgtctcggaagcagatcccatctcagtccatgctcgtgcggaccaggctgacactgacaggcactagaagctccggcaccagagcctctccatctgccgtgtgtctgtgctgctggacatgccccagcagaagctttcctgccgcctctccaagcggactgagagcacctgttggagcacaggctcctccagaagtgacactgagagccagctgtgccagctccgccagcaaagcttgtgcaggactttggccttggggagcccaagtgcggatgaagaagaaggacagcaccatcttcatctaccccaggctgaaaaccttcggcgtgccactgggcagcattctgtgtctggctggaagcctgagcacgatgatgatcattagcaccaccagacaagagtgcggcagacgggccagcgtgccctgtagacctatgatcggaagcgccagacctggaccatggcggacaagtgctatgccttctgccatgggagtcgccctgcctaccagctgtgaaagcggaagatctcctcctgccaccggcggaagaatgccaggatctcagtctatcatgatgagctggatgcctccactggctccctgcgctgcttgtccttgttctcctgctcctacactgtgccctgctcaccctgctagagcaccaacagccgtgcctgcctttacacccctgtctgctcatcctgtgccagtgctgtctggatgtcacctggctgtgcggacctccatgcttaccttgctgccaatgatgaccctgaaggccctggtcaagacatggacccagttcagaaactaccccagacggcaccctcacagaagcccaccaacaagctgtcctccactgctcgaggcctttccactgccaagagccagcctgagagctaccgtgcctagacactctagcgtgctggccacaggactgcatctgcataggcagattagcctgcctctgcggggcttcctgctgcatcaaccactgccaggacaacacctgtggctgtcccacagactgagactgcggctgcctagaacaaccgagatccagctgaccatgaacgactccaagcacaagctggaaagccccgctctgaaacaggtgtccccagctagtcctcctacacagcagcctcagacaccccaggattctagacaggtgctggccgtgcctatgagcctggcctgtagcatcaccgtgtccttcgtgggccagatctctaccctggtgctggacgtgtcctccatcagccactggaacggcatctgggaagtgatgcccagaacactggaaggctgcatctccgtgaaggaccaccggacatcccagaaccacagcaagtgcatcaccgagtgtgtgcggacagccctgaacaccaagtgtgaaatttgtgtgaagaacaccgccatcctggctatcaccctgatcaccccacaggaccctcacctggaccctgtgtgtcatccccatagaaggcccggctggaagggacaccacagagtggtgtttagccaccatccttccggcagcaccaagtctcactggcagcagagagaaagaggcggaggccgcagagaaaagaagggctgtagagaggcaagcagagccggccagtttcctgtgtggcggagaacatctagaggcatgtccctgcagtggaagtccggcaatgcctgcacacctctgagatgtcccagcagatctccagccaccttcctgactgccctgaacggctggcatagatctggactgagggcccagaccgccttctttctgctggacatcatcctgcggagagcccggcctacaagctgcagcacatgtagaatgtggtggcggctgccctgcaaagtgaccgaaagctccctggccaagaaaaccctgaccaatcagcctagcttgcccggaccttgtgctagcctgctgtctacactgagccagccaccacctcaggctcctagccaagtttggacagccgctacactgcggtgtcctgctgtgcctgctgctgcatgtccacctctgaagctggctccactgcaagtgaccacaacactgaagctgatcctggtcatgctggaaatcgtgaccgagaacaaagttcggcagaacttcaagcggaactccagcttcttctacaccagcgacagaggctacccctacgatgtccctgactatgcgtcc

SEQ ID NO: 1200 - DNA, 5232 bp, Artificial Sequence
  Polynucleotide encoding the hINV - and HA-extended poly-FSP polypeptide 2D
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgcggaagatgcagagcctgaatcaccccagcagactgaccaacaatcctcggagaaagacctggaagatgcggaagaagtacgcccagaagcctagccagaagaaccacctgtaccggcagatcaaccggcgcaagctgcagagaaagaagtccagaagccacctggacttcagcccctactggatgaagaaagtgaagcgggccagaaaccggaacatgaagaaaaccatgagccacctgatcgcccatcaggccctgaagatgtctggcctgagactgtttcaccccagactgctgaccagaaagaagcccggcaagcagaaaaagggccacatgatcttcagccggcggaagtggcagatccggcacgtgctgaagaatctgatccccagcctgaacgcccagtggatgttcctgagaatcgctagcccacagatcatgcagagaaccagcgccgaccggttccggatgaagcggagaatgcagaacctggacaatctgggcgtgccctggcctctgttgcctggattgctgctggcccatatgtacggcttcagcacctacggcacccagaaaggcgagtgcgtgtgtctgcagtgtctgagcggcagcagcctgttcatcctgaagcagcccctggacctgaagatctccaagaccttcatggccagccctcagattatgcagcggatgagcgccgtgaacttcgagacaatcctgcaggcccatcctcaggtgccagctcttgctcctcaagcttggtggcccgctagaagaggccctctgacatctgctccaagcgcacagcagtccctgacacggacactggaaagcgccggactgtttccttggctgcacacccagtgccgggccttcattcacacacctagaagccctggctgcagcgtgtacgccaacatgtgctggcggtacaagaaacggggagtgatcgcctggcggatctaccctcctagcacatgcagcctgccttgcagaggcctgatcctgattcagcacggcggcatcttcaccttccggttctgggtcgagaagctgagctggaacatctgcaagaacctgagcctgtacctggataagttcgtgcagcggctgctgtacgtgtacatcatcgagacaaacgtgttcgtgctgaacctgttccacgtgccagtgaaccagatcttcatgatggccttctacctgaagtacaccgagaaggcctgggtcatggaactggaatggctgatccagcagcagtgctaccagcggaagagaatgaagaccggcgccatccaagagaagggcgctattcaagagaaaggggccatgaccaagcggatctgcgtggtcaatttcgaggcctgcagagagatggaaagcctgagcgcccctgagaagatcaccctgtttgaagcccacatggcccggtgcaccagcatcaatgtgctgtgtgtcagggccagcctgatcgagaaactgatgaaagaaaagcgcaagatgaagcgcaaccaggtggcatcccctcaaatcatgcaacggctgttcatcaagggctaccagaacaaccacttcacgttccacctccaaaacttcgccttcttcagctccttcggcaacaacaagtatatcaacatcctgacctttctgcccagcagattcccttggggacctcctccactgggagcccttagagctacagctcctgctacagctgctccccaggcacagacacctcattggagagccgccaccacaagcagcatgagcagctctccaagagccgagcctaccagctctagctcttgggccacttgctggcctagatgctgcagctccagctgctattggagcctgtctagctggcctcctgctggcgctgccgaagccacaaataccagaaccagaagccgcgagagccagcggggaagaatgctgacttggagaagctccctgtggctgcagggcaccagatgttttacaggcgtgcggaccagctccaggtgcagcctgatggaacagatccctcacctgaagtctaacagccggaagaaactgctcgaggacatgaagcagaacggcttcaccagacggcggaacagcagaaagcagagccaagtgcagctggccatccaggtgctgctggtggacaagcacaagtactttctgttcggcagagccacatttctgctggctctgtgggagtgtagcctgcctcaggctagactgtgcctgatcgtgtctagaaccctgctgctcgtgcagtctagacacccaagctggccttggaccagatgcctgagaatgcggcctccacgcagccactggaactctgcctacctggggagaacactgctcgtgacctgcatcctgtaccacagatggatcgtgaccagcatgtgccagagccagagatggctgacctccaccacctctagaagctctgccctgatgtggacctggtggtgtacaagaggtggcggcaagcggaagaaaaagatgtgcaaggtgtccggcggctgcaccgcctgtgttgaaagatgtccttggaagggcatctgttggaagtggcctgtgacagtggccgccatgagcagaacacctccaagacgcgtgtgcggccacagagagggcagcgagtctgataatctgggcctgctgtactcctttccacctgtgctgttcaaggccgaccagagcgaaagctctctgagcagcggcaacagcgtgatcgtgcacaagatcgtgctggtgttcctgaagtccctgagcagctacaactgcgagagaagaatcagcggcatccagaagagagccatcgagttcgccgtcctgaagctgctgaacatggacctcggcaagggactgacacaccccgtgcctctgaagaggaccctgcagaacaagcggaacaagaacatcaagcgggtcaaccagaagaagggcaacatcaagaggaagtccatcctgctgcatctgattgtgctgaacagccccgagagcaaccgggaaaagatcatcaaccccaccatcagctgcccctttcagagccccacaaagagactgggaagccctcctctgcacctgtgtcagcctctgaggccctatcctatcagcgagggcctgaccatgaccaccggcagaaacatcaacagcaactccctgatgaccaactgcctgttcagccccatcttcctgtgccaccacgccatcatgcaccggaagatgacaagccctcacttcagactgttctccagcaagatcccacatccacaggtcccaagtgtggtggccctgtgcaagtttacacacccctgcaccatgctgctgccccaaggcgctttttggaagcctcctagccagggcatctccagctgtctgatgacaggctgttggcagtggtccagcgtgacaagcctggaatggacagcccaagagagaggctgttcctcctggctgatgaagcaaacatggatgaagtcttggtccctgcgggaccccagctacagatccatcctggaatacgtgtccacacgggtgctgtggatgcccacctctaccgtgcctaagttctttctgaccttcagccagatccggatgtgcgccctgtctcaccctagcttctacatcagctccaccgtgtgctttctgagcaagcactgcatgaccgcctgcacacctggaaccagcctgcagtgttacctgaacctggccaacggcctgtggttcaacctgatcttccggaacaaaaagaccaagctgtggttctccctgattaacatccaccaccgcaagaacccactgctgcccatgcggctggaaaaaaaggccacttggatgcggcggaccgagctgtctctggaaccttggattccttacctgcatcagcagaaaacccagtggctccccatgagaagcctgggcgagccttggcgagctggatttcagtggggagagtctccctggcaagtgatggcctctctgacaggcagacgcaagaaaagagaggatcactgcggactgcaagagaaaaaaagccggaagctgatgtccagctgcgccgctcctccacatagactgctgggacctagcagatggggaagctgtgggagagcctgttcttgtggcagaggctgtggaacccctagaggcgactggaagagacacccacctcggcggattctgtttcacgtgcggaacatcgtgtacggaatccaagtgatgctgtgctgtcaccccgcctggctgtctccaatcagcgcttgtcctcgcctgctgccttatccattccacgttctggccctggaagtgacattccctccaggcactgccatgcctcagatgcaattgcaggcactggcaatgtgggagaaaggctgggacaagcctctggaaaacacacagatccccaggacaagcccactgtggaagatcacaatggtgctgacataccccaactgcgtggtgcacgtcctgatgttcggcggcaagaagcggagcaagttcggctacccctacgatgtccctgactatgcgtcc

SEQ ID NO: 1201 - DNA, 5247 bp, Artificial Sequence
  Polynucleotide encoding the hINV - and HA-extended poly-FSP polypeptide 3D
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgcagaacaccagaagcaccaacctggaaaagaaccccagcctgaagaagcagagccagcggagaggaaagctgagcagcagaaagaagggccacaccaagaaccggcggaaggccaagagaaagccccagatcagccagaagaaggaccctgccggcaagctgaagaaacacctgaaccggaagctgcacctgaccagatcctgcctgatcgacctgaccatgatgatgagccagaagctgtggaagaaccagcgcaagagaatccctctgccttctccacggcagcatctgctgcctcagtatccactgcatcctccacctccatgcctgctgctgctccaccacagacaccatctggcctttctcgagatggcctgcagcagccagcacacccacagcatcaagatctggatcagcttcagccacgaggacctgcctagaatgctgcccatcagcagccctctgcacagaccccagatgcctttctggacctgcacctttcctgccaccacatggggcacatgggagacaccttctacatggggctggcggacattcggccctgtgtactacgtgtgcaaccggatgaacgtgtccagcgtgctgaagcctttcctgttcaccgtgcctatcgaggacatgagagagtgcaccctgggcagaaacagaatgaatgtgtcctctgtgctgaaaccctgtctgatccccgtgccaatcctgaccacactgagcttcgtgctgatcgaggaaagccggcggaacagacggtacagaaagatctacggggagctgaagatgtccctgcaggccctgcctctgacctttagcacactgctgtgggacagcagacacaccaccaccacaagcagccccagaagatcccctgctctgagagctagaggcggcaccacaatcggcgaagtgacaagcagaggcgccagcagctctaccagcagagacagcagaagctttttcaccagcgctcaccccagcagaccctgcagaatgagactgtaccagagcaacggcatggaagcctgcggcacacaccctacacctagactgtctagaggccctccactgcacaccagaaccatgagcctgagcaacatcctgatgaagttccggctgatgctgcagaagcagtgctgctacaacctcgtgatcaagcaccctctgatcttccggatcaacctgcggagacagggcaagaccaaagacggcgttgtgcagagcctgggcttcctgaaccagcagatcatcctgcagaaagagttcttcatctgcctgctgatgttcatcaagcggtggaagccagccgccacaaagacacctccaccactgattctgtggcctcaggccgctcctgtgcacaagaagagaggcctgttcagcctgttcttctcccactgcctgtgccaccagatgaagtgcctgaccgccgtggattgtctgcaggccttctgggacatgatgattcgcaagatccagaagcggcggagaaccgccaaccggctgaaaaagaaatacctggtgcagtgtaccaacctgagcgtgcccatgatgctgaccatcctgatctggaagcgggtgttcatcctcctgctgagcgacaagaagtgtctgagagtcagatgcggcggatggctgtgtggctggacacctagaggcaagaacaagaagcggagaaagctgcggcccaagcacctgaagaaaaccagcgccaaggtgtccgtgatcaccatgaagctctgggagaagcacttcaagggcctgaactggaacctggtcgtgtggattctgaacctgaagatgatgtggctcaagaagtccaccaagagcagacagagcagcccattcctggctcggagctggaataccatgcaatggaacaacaagaaaatggccatgaccgtgatcgctggcgcccaccactgtcagtacaagctgacctacaccaaagtgtggaagatgaattggaagaaaatgatgatcggctcccagcacctcctgtttagcccactggattcaagcccactgcagttgctgctgcaccctcacggcaagagatgcaacccttgctgcagactgacctggatgagcagagagtgggaaaagcggaagcagatcctcggcggaggcggcaagtacaaagagtacttcctgaagcggattctcatccggaaggctatgacagtgctggccggcgataagaaaggcctgggaagattcatgagatgcgtgcagagcgagacaaaggccgtgtctctgcagctgcctctcggccgaagaaagtccggcgtgatgaagtgttgggatctgtgccccagactggactttcaccccagatctagctctggcggcgagaagctgaagcactgtttcaaagcctggggcctgtgcttcttctacctgctgtacttcgagaagaaacggcccgagtggctgagcgttgaccctcctggatctgtctggattctgccctgcatggacctggacggaatgctgacagtgatcggccagggactcgtgggcatgacccctagagatctgggaacagtggctggcgccaccgcacagattcagaggcctatccaggtgcagacaggcggcagactgttcctgattcacctgagaaaggtggacacccaccatctgcaggtcgtgaccaagaccgtgacagccacaacagctgacggccagaggatgcggagactgaagtgcaaggcctgtcggctgagatgggccagacctgaacctgctgcacaggctcctccaaagagccactttccacctcatcctagcggcccctccagaacctctagcctgcagctcagacccattcctccacacctgagacacccactgctgctgaagggaaagaacagcccctgctgccaaaagaaactgcgggtgcagaaccagggccatctgctgatgatcctgctgcataacgccagacagcccagcaggcctaccggaagaacccctaccacaagactgatggcccctgtgggcagcgtgatgtcttgtagcctgctgacccagccatctcctgccagcgcatgtacaatgccaccactcctgcatccacagtgggccccacatagtgctggactgtctccaggcgcttgcagacctgcctgtacctgcatcagcatgaccaccatctccagagccacatggcggctgagaatcccaagcctgaggaagtaccggcagaacatcgagatcacccctcagcggtctaaggcccaggtttccgtgtacagcggcaatctgctgagcttctccagacggggcatgaagagtagcgtgcggctgaagaacagcatccctcacgtgccaaaagccaccgccgctcactctgtgacagtgaagctgcagtacctgtttttcctgaccgtgtgcggcttcgaccgggtgttcctggttaagatctgcaagaagaagctgctcctcaagctgctgagaggccccagacggaaagtgctgatggtgctttggctgcccgccaaccagagtctgcagaaaagccaggtgttccagtgggtgctgcggaccgaaacctacatggaaatgcactacggccatcaggcccctcaggtggccatgctgcctaaactgctgtgtagacagatgctccccactctgtccacactccagcagaggcatcctcagggaccttgtcctcctcctgtgacacctctgagagtgcagtctgtgctgctcctgggagtgcctcagacagccgcttttagcggccggattctgcaccagccagaaatggccgccatgagactgatgcccaagttcctgaactccaccaacagctggtggacagtggcccctagatgtcctagaagcgccgtggacattagccccggacctacatctcctagcctggcctcttgtgcctctgtggccattggaaaactggcactgctgggcgcatctgccccttgtggcgcagctggtgctagagaggctggaagatttgccgtgctgggcaccatggttatgaagggtgctgccgcagcctcctgtcagtctcctccatctccaagagagacaacccctagcagcgacgccaccagacggacaagacctattgccgctcagagcaaaaagaccatgactgccgccggactgacccctcggagaaacctgcagagaaatctgaaggtcctgggcgccaagaagatcaccttcctgagaaacagcagacgcgccacacctacctctaagggcagcctgagaagaaagtacctgagagtgaacatccgcaagctcatctggaccaagcagcggagcttcctgtctctgttccccaagctgagagccaccgagcagatgaccaatgtgggatgcctgctcaagaaaagcagccaattgcggcggagctggcgcaatgtgtcccggatcagcaacatggaacacaggctgaccatggacagcgccctgagcctgacaaagagagagggccctgagacaagcgagaagaagaggaagttgcctggctacccctacgatgtccctgactatgcgtcc

SEQ ID NO: 1202 - DNA, 5250 bp, Artificial Sequence
  Polynucleotide encoding the hINV - and HA-extended poly-FSP polypeptide 4D
atgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgaacagaaagaccagaaaggccgccagagagaagcaccgcaagaccgacgacaagaagaagaagtccaccgaaaagaccaagaacgccaagaagatgcccttccagcagcggcctcctctgcagcctgttaacctggatctgcagcaccagcgcagacgcaaaaagaagaaagacaaggtcgaaatccggaatcggagccctaaggccaatagcaccgagtgtcagggcgagcacagcagagagcagaacctgctgaatctggtgcagctgaaccctcacagccctcaccacagaaaggacgaagaggaccaccagaagcggcaccaccaccacaatcaaaagaaaatgagcgtgcgggctagcgtgtccttctggacacttttgccaacaaccggcgtgcggacaagaggctctccactgagactgacactgtggcctccacgggttccaccttctccacctcttgctctgggccccagaatgcagctgtgtacccagctcgcccggttcttccctatcacacctcctgtgtggcacatcctgggacctcagagacacacacctcaggctcctctgaggctgtggtcttggtgcggcacaagccagacctacttcggcagcagaccatctccttgcctgagctggtccagcagaattgtggcccctggacacgccctgagctgtcggactagaagaagatggtctagcaagcggtggatcttctccaaccagctgaccgtgcagatgctgtgcctgccaatcacacacccattcgcctctcagcctctgggacaagagatgcccaacaacacccagatccggctgctgaagccctgcagagtgaacgccgtggaagaactgcacagcaggcggatgtctgtgcggatcgtgaagaactgggtgtcctgctgttacgtgcggctgtctgctgtgggcctgtctacttggagtgccctggacgaggaaaagaagaacggccggatcagcagcctgaaaaagaaagtgaatgcctgcagctccctgatcctgagcttccagcgcgtgaaaaccggcatggaaatcctgctgtggattctgctgaagatggaaattcagatcttcaagatttgcctgggcgagatgcagctctgcggccaggcctttggaagctttagcgccgatttcagcgcccctcagatcattaagaagatgaagaaacggatcatggtgcacgagctgaagaagaatctgctgctgcctatgtgctccagcctggctctgccaacaggcctgacatctctgatcctgcctagcagcgatctggccgtgctgatctctagctccaccagccactttctgatgcggagccctgtgctgccaagcagcagactgacttgtgcctctccacagctgccccggatgtggacttggtctagctggctgaagaacgagggcaacaaccactggcctagagtggaaatgcctaccggctggctgctcgtcggctacaacaccagaaacacagcccagaatcctcggctgcagcagcacctgaaacactggcagcagtgcaccagagccagatggtgtcaagagccctgtcagaccctgaccttcttccatttcttcttctttttcaaaacggtgtccctgtgttgccccggctggtctaaaggacaacctcctccacctggcctgaagccttctagcctggcttctcaggtggccagaaccacaggcgtgtaccagcacgtgtggctgatctgtttcgtgtttttcgtgtgtgtggaaaccggcttctgtcacgtggcccaagtgggactcgagagactggtgtctctgtccggcatcaccgacgtgaaccattgggcccagcctaagccatctcctagcaaaggcaccggcatgaacagacccatcggcctgagagttggcaaaggcgtgtgggccagactgatcctggccatgacactgaccctgaacggcatggccaagaagtcccagcagcctctgcaggtcgtgctgagactgggaaacctgcctccattcttcagaggcagcgaggtgccctttcctagaccttgtcggaccaagcctgcctgcacaagcaaggcctggactcccagaaaactcgtggggagagccgtgcggagaaagggatctccactctgggattgctccaccacaacaggcacacaccacggatgcctgtgggagatcccatctgtgaccctgctggcccatcctagaaccgcctctatcaccctgcctaccacaagcctgaagggctccagaaccagctgctgccctagatctcaccccagactgcctaggaccaaatggcccctgcagtgtctgctgcacagcctgggaacaaccggaacactcgtttgggaaaggggcgtcctgcagatgagatccctcgaagcccattgtccactgcagaccttccatctgcaccactgcaggacccagcctagctcttgtcctcctgcctggattctgtaccaaggacagtggagcggagccgtcgtgggacttagacctgtggctcaccatctgcctagacctatccagggcctgcactgtccacaggcacctcatcaacctgctctgagctggggaaaatggcccgtgggaatgacaggccctgccagatgttgcagatggcccagacggtgccagaagaaggttccatcagcctctccatggggcctcgtgctcaaaaagaaccggaaacagatgctgaaccagaagtgtctggccccttttagagagagcaccctgggcaatttctggatgaagctgctccagctgcctgtcgtgatcaacctgaagagactgcagaagttcaacctgcacctgtgctactaccacagccagagcaacagaaacaagagccgccagatggaatccctgggcatgaagttgcagtcccagaaatcccagcaccactgtgccctgcggaagatcgagtgggccacaaagttgtctctcggcggaaaagccggaccacaggctcaagagaaggccacctctcggattctgaacctgcaagtgctcaagaagatcctgcggagctttatgaagctgtaccactctctggtcatgtgcctgcggctgaggaccaagctggaaaaggctctgagcgccctgttcatctggccccagcacagctacaagcccctgttctttcacggcgacctgtgcgagtggggaggccaggctcatagacagcggaactggctgaaaaactggaagcggttcaagcttaaaaagaagtacatccagaagaagaagcagaagtctaacaagatcatctgcaagggccaccgcatcaccatcatctgtatcaagaatatgttcctgcagcgcaagggcttcctgaacctgagccacgtggaaaagttctgtagaggcggccctagcgccagcgatagatgctgttcttgtagccccagcggcttcagtgccggcagaggaagatgtcctgttcagggctgtctgaggccccacagagttcaactgctgagaagatggggccctggctctcctgctggacagaggctgtctaagggctttcagctgctccgttggtggggaccaggatctcctgctcctgagcctagaaagggcccatttccaccacctgatcctccatggcctgtgaccgctgtgacagtgatggctggatctgtgcctagtgctcagtctgtggacgccctggaatctcctggacctctggctctcgaaggacctagcagccctagaaacctgctttggagagagatgagcatctttctgcccggcatcttcaccgccaagaaaagccccaccagcttttgctgcaatatcctgaacagcctgccaagctctatggaaatcgccgtgctgcaagaggacagcaaaaagatgacccagaagggccaagccttcggctccctgtgtcagcttgtgtccgctgacttctctgcccctcaagtgacccggctgcggagcctgaatcatctgctgatcacctacacaccccacatctgcagacacaccctgctgacccctgacaccagatggatctttagcaatcagctgcagacagtccagatgctctgtctgcctccactgaagcagggcgagagaatcatttggcccctcggcggctttcagatccccaacttcttttggagcctcggcatcggacacactggcgcctggtggcatactggaaggcggagaagagaatggggcggcagcaccgtgtctagaagccctctgtggatcagctccatgatctacctgagaggcatggccttcgccagcgacagcagcatcagaaccaccagagtgtcctggtgcagaagatgcggcgccaaaagcgctgccgccagctctattgaagctctgaccgctctgtttacctgccggaccgccagcatcagcgtgaacatcagcaccctgatgtccatcctggaagcacttaagaagaaacccagagacatctgccgcatcagctgccggtgtagacgcgagtacagagtgactatgggctacccctacgatgtccctgactatgcgtcc

SEQ ID NO: 1203 - DNA, 4690 bp, Artificial Sequence
  Cloning cassette hTPA 1C
gaattcggatcccgcgacttcgccgccatggatgcaatgaagagagggctctgctgtgtgctgctgctgtgtggagcagtcttcgtttcgcccagccaggaaatccatgcccgaagcaccagacgggaaatgccttctcaggccacaccttctccacctggaccttggagagccgctctgggcaaagaagtgaagcggagccagagcaagctgcggctgagaaacacaagccccaccgagatccaattgaccatgaacgacagcaagcacaagctggaaagccccgctctgaaacaggtgtcccctgcctctccacctacacagcagcctcagacaccccaggatagcagacaggtgctggccgcttcttctcctggacatcctcttggccctggcgactgccctagaacaatggctggaccttctgcctctctgcacccagcatctggcagagccagcagaaagacctggcagagaaggctgagagcctgtagagctggtggacctgctggatgggctagacaggccatgacactgaaggccctggtcaagacctggacacagttcagaaactaccccagagtcggagccggaacaggcggaggacctgcttgtgttcctgtggccgaagcttctactggcgcctggacagctgaaggcgctgccggaacaagatgcagagcttctagagccccttgcagacagctgcctgccagctctcctaccaagtgcgagatctgcgtgaagagaaggcggcggagaaagcggagcagccagtctagatctcccgtgcctaagaaacgcgagcggatgatgctgcctgtgcgggccagaacagctagatctgctctgccacaaggcagagcccctctggaaggaatgcttctgcctagagcactgcccagcctgctgagcagaatgccagccagaagagagagccggttttggctggcactgcaggctctgggactcagacctcctcatctgcctagctgtcaccctctgcctcaactgcttggacctcctccacctcatcaggcccctttcgacaagaaaggcttcgtgatcctgagcaagggcaagaagcgccggaaagaaatccggcggatgaccagacggaccatgaccaccaccaaaatgatgatgatgcggcggaccaagcggcggaggcgaaaacgtagaagaatgaccatgatgacccgcagaaccctgctgaccaagaaaacctgtctgacccctagaaccagcgccgccacaaaagctctgcccagacagacaatcagccagcggaggcctatccagacacctcctggaacaagcctggccatctggggcagactgcctctcagaccacagagaggacctcggcctctgcatagatggctgcagcagacaacaggctgctcccagagaagaatcgccaagaagcggatcaagctgaggcggaacacactggccatccggtttatctctgcccctcagcctagcagcagcaccgttacagctgctcctagcggccagtacttcagcagcttcttctacaccagcgaccggaccaagtgtgaaatctgtgtcaagaacaccgccatcctggctatcaccctgatcacccctcaggaccctcacctggaccctgtgtgtcacccacatagaaggcctggctggaagggccaccacagagtggtgtttagccaccatccaagcggctccaccaagagccattggcagcagagagaaagaggcggaggccgcagagaaaaaaagggctgcagagagatgcccagcagctggtctagctctggcagaaccgccgacaaaaagaacgtgcggagcagaaccagactgaccctgacaggcacaagaagcagcggcacaagagcctctccaagcgccgtgtgtctgtgctgttggacatgcccctccagaagcttccctgccgcatctccatctggactgagagcacctgttggagcccaggctcctcctgaagtgacactgagagccagctgtgcctctagcgcctctaaagcctgtgctggactttggccttggggagcccaagtgcggaacaaagtgcggcagaacttcaagcggaacctggccaaaaagaccctgactaacgccctgcggagtatgcccaagagcagaaaccaggtgctgttcagacggaatctgaccccaagccagctgagaactctggcccctccttacatgctgctgccccagtctctgtctcagagcctgtccagaaagcagatccccagccaatcaatgctcgtgaccgccttcttcctgctcgacatcatcctgagaagcctgctgtactcccggatgtgcctggtgcagatccctacacacacctgggagcccgactacttcgtgtccctgcctatgatgttcagctgggccactcagagctttccagtgggagccgtgttcctgaccagacctgccattccttgctgcagctgtaccagccacagcaacccttggagccagtccttcaagaagaagaagcccctgacattcagccccagcgtgccaatgtctctggcctgtagcatcaccgtgtccttcgtgggccagatcagcacactggtgctggacgtgtcctccatctctcactggcgcaagcgcaagagagagaagcggtcccagaagtcccggcagaaccatctgcagctgaagtcctgcagacggaagatcagcaactggtccaagctgagatccccgtggatcttctaccctcggctgaaaaccttcggcgtgccactgggctctatcctgtgtctggcaggctccctgagcacgatgatgatcattagcaccaccagacaagagtgtggcagacgggcctccgtgccttgtagacctatgatcggcagcgctagacccggaccttggcggacatctgctatgccatctgccatgggagtcgccctgcctaccagctgtgaaagcggaagatctcctcctgccaccggcggaagaatgcctggatctcagtctatcatgatgagctggatgcctccactggctccctgtgccgcttgtccttgttctcctgctcctacactgtgccctgctcatcctgcaagagcccctacagccgtgcctgcctttacacctctgtctgctcaccctgtgccagtgctgtctggatgtcacctggccgtgcgcacctctatgctgacactgctgcccatgagacaccctcacagaagcccacctacaagctgccctccactgctggaagctttcccactgccaagggccagcctgagagctaccgtgcctagacacagctctgtgctggccactggactgcatctgcatcggcagattagcctgcctctgaggggcttcctgctgcatcaacctctgcctggacaacacctgtggctgtcccacagactgaggctgagactgccaagaacaggcgagaagaacgacctccagctgttcgtgatgagcgacaccacatacaagatctactggacagtgatcctgctgaacccctgcggcaacctgcacctgaaaaccacatctctgcggagagccagacctacctcctgcagcacatgcagaatgtggtggctgaagctggccccactgcaagtgaccacaacactgaagctgatcctggtcatgctggaaatcgtgaccgaagaggccaagaaatccatgaagagatcccggcggagcaagatcgaggcctctcctatcggctccatcatgaagaagaaagacagcaccatcttcatcaaccagcagctcaagtggacccctcacatcctgaagtctgccagcgtgtccaagaagagactgcccaagctgaacggcatctgggaagtgatgccccggacactggaaggctgcatcagcgtgaaggaccaccggacaagccagaaccacagcaagtgcatcaccgagtgtgtgcggacagccctgaaccagagaaaggtggtcaagaaccccagccagccagtgccactgagaaacgacggcatcaccaacggcaacgactccaccagatcctgctccatcagcctgaagaaaagcctggaaaagatgcccctgatgaacgccaagaaaatggaagatatgatctgggagagcaacatgggcggcaaccggtccatctgcctgacaagactgccctgcaaagtgaccgagtccagccaaagaccacctcggagcattctgtccctggcctctagagccggacagtttcccgtttggcggagaaccagcagaggcatgtccctgcagtggaagtccggcaatgcctgcacacctctgaggtgccctagcagaagccctgccacatttctgaccgcactgaacggctggcacagatctggacttagggctcagcaacctagcctgccaggaccttgtgctagcctgctgtctacactgagccagcctccaccacaggctccaagccaagtttggacagccgccacactgagatgtcccgctgttcctgcagctgcttgccctcctatcgtgttctttctggccccatacttccccacaccactgagcatcagcagacccacctctcgggccagacagtcttgttgtctccccggactgacacaccctgctcaccagcctcttggctctatgggctacccctacgatgtccctgactatgcgtcctaaaggcgcgcctagcggccgc

SEQ ID NO: 1204 - DNA, 4672 bp, Artificial Sequence
  Cloning cassette hTPA 2C
gaattcggatcccgcgacttcgccgccatggatgcaatgaagagagggctctgctgtgtgctgctgctgtgtggagcagtcttcgtttcgcccagccaggaaatccatgcccgacggcagatcaacagacggaagctgcagagaaagaagcgccggaagaagagagaggaccactgcggactgcgggccagaaaccggaacatgaagaaaaccatgagccacctgatcgcccatcaggccctgaagatgtctggcctgagactgtttcaccccagactgctgacacggaagaagcctggcaagaaccctcggagaaagacctggaagatgcggaagaagtacgcccagaagcctagccagaagaaccacctgtacggcaagggcctgacacaccctgtgcctctgaagagaaccctgcagaacaagcggaacaagaacatcaagcgcgtgaaccagaagaagggcaacatcaagagaaagagcatcctgctgcacctcatcgtgctgaacagccccgagagcaacctgcaggctcatcctcaagttccagcactggctcctcaggcttggtggcctgctagaagaggccctctgacaagcgctccatctgctcagcagagcctgaccttcctgcctagcagatttccttggggccctcctccactgcactggaactctgcctacctgggcagaacactgctcgtgacctgcatcctgtaccacagatggatcgtgaccagcatgtgccagagccagagatggctgaccagcaccacctctagaagcagcgccctgatgtggacccagtggtctagcgtgacaagcctggaatggacagcccaagagaggggctgtagcagctggctgatgaagcagacctggatgaagtcttggagcctgcgggaccccagctacagatccatcctggaatacgtgtccaccagagtgctgtggatgcccacatctacagtgggagccctgagagccacagctcctgcaacagctgctccacaggctcagacccctcattggagagccgccacaacaagcagcatgagcagcagccctagagccgagcctacaagctctagctcttgggccacctgttggcccagatgttgcagctccagctgttactggtccctgtcctcttggcctcctgctggtgctgccgaggccacaaataccaggaccagaagcagagagtcccagcggggcagaatgctgacttggagaagcagcctgtggctgcagggcaccagatgttttacaggcgtgcggacctccagcagacacccttcttggccttggaccagatgcctgagaatgcggcctcctagaagcaacagccggaaaaagctgctcgaggacatgaagcaaaatggcttcacccggtacaagaaacggggcgtgatagcctggcggagagccactttcctgctggccctttgggagtgcagtctgccccaagctagactgtgcctgatcgtgtctaggaccctgctgctggtccagagcagatgcagcctgatggaacagatccctcacctgaagtcctggtggtgtacaagaggcggcggaaagcggaagaaaaagatgtgcaaggtgtccggcggctgcaccgcctgtgttgaaagatgtccttggaagggcatctgctggaagtggcctgtgacagtggccgctctgatcctgattcagcacggcggcatcttcaccttccggttctgggtcgagaagctgtcctggaacatctgcaagaatctgtccctgtacctggacaagttcgtgcagcggctgctgtacgtgtacatcatcgagacaaacgtgttcgtcctgaacctgttccacgtgccagtgaatcagatcttcatgatggccttctacctgaagtacaccgagaaggcctgggtcatggaactggaatggctcattcagcagcagtgctaccagttgctgctggctcatatgtacggcttcagcacctacggcacccagaaaggcgagtgcgtgtgtctgcagtgtctgagcggcagctccctgttcatcctgaagcagccactggacctgaagatcagcaagaccttcatgagcagatcccacctggatttcagcccctattggatgaagaaagtgaaggcctctccacagatcatgcagcggatgagcgccgtgaacttcgagacaatcaggcggaagtggcagatccggcacgtgctgaagaacctgcctctggaaaacacacagatccccaggacaagccctctgtggaagatcacaatggtgctgacataccccaactgcgtggtgcatgtgctgatgttcgtgctgttcaaggccgaccagagcgagtctagcctgagcagcggaatctaccctcctagcacctgtagcctgccttgccggggcattagaatgtgcgccctgtctcaccctagcttctacatcagcagcaccgtgtgctttctgagcaagcactgcatgaccgcctgcaccagagagaagatcatcaaccccaccatcagctgcccctttcagagccccacaaagagactgggccacagagagggcagcgagagcgataatctgggcctgctgtactcctttcctccttggctgcccatgagatccctgggcgaaccttggagagctggctttcagtggggagagtccccttggcaagtgatggctagcctgaccggcaacagcgtgatcgtgcacaagatcgtgctggtgtttctgaagtctctgagcagctacaactgcgagcggcggatctctggcatccagaagagagccatcgagttcgccgtcctgaagctgctgaacatggacctggctagccctcagattatgcagagaaccagcgccgaccggttccggatgaagcggagaatgcagaacctggataacctgggcgtgccctggccattgcttccaggtgctgctcctccacatagactgctgggcccctctagatggattctgtttcatgtgcggaacatcgtgtacggcatccaagtgatgctgtgccggcggagaaacagcagaaagcagagtcaggtgcagctggccattcaggtcctgctcgtggacaagcacaagtactttctgttcggcccctatcctatcagcgagggactgaccatgaccaccggccggaacatcaacagcaactccctgatgaccaactgcctgttcagccccatcttcctgtgccaccacgccatcatgcaccggaagatgacaagcccacacttcagactgttctccagcaagatcccacatcctcaggtgccaagtgtggtggccctgtgcaagttcctggccaatggcctgtggttcaacctgatctttcagaaaaagggccacatgatctttagccccaagttcttcctgacctttagccagcggaccctggaatccgccggactgtttccatggctgcacacccagtgccggaacaaaaagaccaagctgtggttttccctgatcaacatccaccaccgcaagaatcctctgctgcctatgagaatgagcagaacacctcctcggagagtgtgcggatctccacctctgcatctgtgccaacctctgagaggcggcaagaagagaagcaagttcgccttctggaagcctcctagccagggcatcagctcttgtctgatgacaggctgttggggctcctgtggcagagcttgttcttgcggaagaggctgcggtacacccagaggcgactggaaaagacacccacctcgcagagagctgagcctggaaccatggattccttatctgcaccagcaaaagacccagcggaagcggatgaagaccggcgccattcaagagaagggcgctatccaagaaaaaggcgcaatgaccaagcggatctgcgtggtcaatttcgaggcctgcagagagatggaaagcctgagcgcccctgagaagattaccctgttcgaagcccacatggcccggtgcacctccatcaatgtgctgtgtgtccgggccagcctgattgagaagctgatgaaagaaaagcgcaagatgaagcgcaaccaggtggcatcccctcaaatcatgcaacggctgttcatcaagggctaccagaacaaccacttcacgttccacctccaaaactttgccttcttcagctccttcggcaacaacaagtatatcaacattctcacccgggccttcatccacacacctagaagccctggctgttccgtgtacgccaatatgtgctggcggaagatgcagtccctgaatcaccccagcagactgaccaactgtcaccccgcttggctgagccccattagtgcttgtcctaggctgctgccctatccttttcacgtgctggcactggaagtgacctttccacctggcacagccatgcctcagatgcaattgcaggcactggctatgtgggagaaaggctgggacaagcaagagaagaaatcccgcaagctgatgtcctcctgcctggaaaaaaaggctacctggatgcggagaacccctggcacaagcctgcagtgttacctgaacacacacccctgcaccatgctgctgcctcagggaatcccatctctgaacgcccagtggatgttcctgcggatcggctacccctacgatgtccctgactatgcgtcctaaaggcgcgcctagcggccgc

SEQ ID NO: 1205 - DNA, 4687 bp, Artificial Sequence
  Cloning cassette hTPA 3C
gaattcggatcccgcgacttcgccgccatggatgcaatgaagagagggctctgctgtgtgctgctgctgtgtggagcagtcttcgtttcgcccagccaggaaatccatgcccgacctattcctccacacctgagacaccctctgctgctgaagaacaagaagcggagaaagctgcggcccaagagcagaaagaagggccacaccaagaaccggcggaaggccaagagaaagccccagatcagaaacagccgcagagccacacctaccagcaagggcagcctgagaagaaagtacctgagagtgggagccgccgctgctagctgtcaatctcctccatctcctagagagacaacccctagcagcgacgccaccagaagaaccagacctatcgccgctcagagcaagaaaaccatgacagccgccggactgacccctagccagaagaaagatcctgccggcaagctgaagaaacaggtgtccgtgtacagcggcaacctgctgagcttctctcggagaggcatgaagtctagcgtgcgcctgaagaactgcaccaacctgagcgtgcccatgatgctgaccatcctgatctggaagcgggtgttcatcctgctgctgtccgacaagaaatctatccctcacgtgcccaaggccaccgccgctcattctgtgacagtgaagctgcagagccggcggaacagacggtacagaaagatctatggcgagctgaagatgtccctgcaggccagcaatggcatggaagcctgtggcacacaccccacacctagactgtccgtgtccgtgatcaccatgaagctgtgggagaagcacttcaagggcctgaactggaacctggtcgtgtggattctgaacctgaagatgatgctcaagaagaagtatctggtccagcgcgagtgggagaaacggaagcagattcttggcggcggaggcaagtacaaagagtacttcctgaagagaatcctcatccgcaaggccatgacagtgctggccggcgataagaaaggcctgggcagattcatgagatgcgtgcagagcgagacaaaggccgtcagtctgcagctgcctctgggcagaatggacctggatggaatgctgaccgtgatcggccagggactcgtgggcatgacacctagagatctgggaacagtggctggcgccaccgcacagattcagaggcctattcaggtgcagacaggcggcagactgagaggccctagaagaaaggtgctgatggtgctgtggctgcccgccaatcagagcctgcagaaaagccaggtgttccagtgggtgctgagaaccgagctgcccctgacctttagcaccctgctgtgggacagcagacacgacctgcctagaatgctgcccatcagcagccctctgcacagaccccagatgcctttctggacctgcacctttcctgccaccacatggggcacatgggagacaccttctacatggggctggcggacctttgccagacagccttctagacccaccggcagaacccctaccaccagactgatggctccagtgggcagcgtgatgagctgtagcctgctgacacagccatctccagccagcgcctgtacaatgcctccactgctgcatcctcagtgggcccctcattctgctggactttctccaggcgcttgcagacctgcctgtacctgcatcagcatgaccacaatcagcagggccacctggcgcagaaacctgcagagaaacctgaaagtgctgcggctgagaatccccagcctgcggaagtacagacagcagaacacccggtccaccaacctcgagaagaacccatctctgaagaagcagagccagaggcggggcaagctgtctctgaccacactgagcttcgtgctgatcgaggaactgctgaaaaagagcagccagctgcggagaagctggcggaacgtgtccagaatcagcaacatccggaagctgatttggaccaagcagcggagcttcctgtctctgttccccaagctgagagccaccgagcagatgaccaatgtgggctgtagactggattttcaccccagaagcagctccggcgacagagtgttcctggtcaagatccagagcagcccattcctggccagatcctggaataccatgcagtggaacaacaagaaaatggccatgactgtgatcgctggcgcccaccactgtcagtacaagctgacctacaccaaagtgtggaagatgaattggaagaaaatgatgatcggcagccagcacctcctgttctccccactggatagctctccactccagctgctgctgcacccacacggcaagagatgcaacccctgttgtcggctgacatggatgagccacctgaatcggaagctgcacctcaccaggtcctgcctgatcgacctgaccatgatgatgagccagaaactgtggaagaatcagcggaagcgcatccctctgccttctccaagacagcatctgctgcctcagtatcctctgcaccctcctccaccttgtctgctgcttctccaccatagacaccacctggcattcctcgagatggcctgtagctctcagcacacccacagcatcaagatctggatcagcttcagccacgagacaatgagcctgtccaacatcctgatgaagttccggctgaccaccaccacaagcagccccagaagaagccctgctctgcgagctagaggcggcacaacaatcggcgaagtgaccagcagcctgttctttagccactgcctgtgcgtggcccctagatgtcctagatctgccgtggacatcagccccggacctacatctccttctctggcctcttgtgcctctgtggccattggaaagctggcactgcttggcgcctctgctccttgtggtgctgctggcgctagagaggccggaagatttgctgtgctgggcaccatggtcatgaagaacatggaacacagactgaccatggacagcgccctgagcctgacaaagagagagggccctgaaacaggccccgtgtactacgtgtgcaaccggatgaatgtgtccagcgtgctgaagcctttcctgttcaccgtgcctatcgaggacatgagagagtgcaccctgggacgcaacagaatgaatgtctcttccgtgctgaaaccctgtctgatccccgtgccaatctgcaagaagaaactgctgctcaagctgctgaggggcgcctccagctctaccagcagagatagcagaagctttttcaccagcgctcaccccagcagaccctgcaggatgagactgtaccagatgctgcagaagcagtgctgctacaacctcgtgatcaagcaccctctgatcttccggatcaacctgcggagacagggcaagaccaaagacggcgttgtgcagagcctgggcttcctgaaccagcagatcatcctccagaaagagttcttcatctgcctgctgatgttcatcaagcggtggaagccagccgccaccaagaagggcaagaacagcccctgctgccagaaaaaactgcgggtgcagaaccagggccatctgctgatgattctgctgcacaacagaggcccacctctgcataccagattcgagaaaaagcggcccgagtggctgagcagaaaatccggcgtgatgaagtgctgggatctgtgccctgccttcagcggcaggattctgcaccagccagaaatggccgccatgagactgatgcccaagttcctgaactccaccaacagctggtggacagtgcacaagaagagaggcctgttccaccagatgaagtgtctgaccgccgtggactgtctgcaggccttctgggatatgagcgagaagaaacgcaagctgcctatgattcgcaaaatccagaagcggcggagaaccgccaaccggaacatcgagatcacccctcagagaagcaaagcccacctgaagaaaacctccgccaagggcgccaagaaaatcaccttcctgtgcctgagagtcagatgcggaggctggctgtgtggctggacaccaagaggatggctgaagaagtccaccaagtccagactgtgcttcttctacctgctgtactacctgtttttcctgaccgtgtgcggcttcacccctccaccacttattctgtggcctcaggcagcccctggcgagaagctgaagcactgttttaaagcctggggcgtcgaccctcctggcagcgtttggattctgccctgcttcctgattcacctgagaaaggtggacacccaccacctccaggtggtcaccaaaacagtgaccgccacaacagccgacggccagaggatgagaaggctgaagtgcaaggcctgccggctgagatgggctagacctgaacctgcagctcaggcccctcctaagagccactttccacctcatcctagcggcccctccagaaccagctctctgcaattgagaacctacatggaaatgcactacggccatcaggccccacaggtggcaatgctgcctaaactgctgtgtcggcagatgctccccactctgtctaccctgcagcagagacatcctcagggcccatgtcctcctccagtgacacctctgagagtgcagtctgtgctgctgctcggagtgcctcaaacagctggctacccctacgatgtccctgactatgcgtcctaaaggcgcgcctagcggccgc

SEQ ID NO: 1206 - DNA, 4690 bp, Artificial Sequence
  Cloning cassette hTPA 4C
gaattcggatcccgcgacttcgccgccatggatgcaatgaagagagggctctgctgtgtgctgctgctgtgtggagcagtcttcgtttcgcccagccaggaaatccatgcccgagacagcaagaagatgacccagaagaaccgcaagacccggaaggccgccagagagaagcacagaaagaccgacaacctggacctgcagcaccagcgcagacgcaaaaagaagaaggacaaggtcgagatccggaatcggagccctaaggccaatagcaccgagtgtcagggcgagcacagcagagagcagaacctgctgaacctggtgcaattgaaccctcacagccctcaccaccggaaggacgaggaagatcaccagaagagacaccaccaccacaatcaaaagaagatgtccgtcaacgagggcaacaaccactggcctagagtggaaatgcctaccggctggctgctcgtgggctacaacaccagaaacacagcccagaatcctcggctgcagcagcacctgaaacactggcagcagtgcaccagagccagatggtgtcaagagccctgtcagaccctgaccttcttccacttcttcttctttttcaaaacggtgtccctgtgctgccccggctggtctaaaggacaacctcctccacctggcctgaagccttctagcctggcttctcaggtggccagaaccacaggcgtgtaccagcacgtgtggctgatctgcttcgtgtttttcgtgtgcgtggaaaccggcttctgtcacgtggcccaagtgggactcgagagactcgttagcctgagcggcatcaccgacgtgaaccattgggcccagcctaagccatctcctagcaaaggcaccggcatgaacagacccatcggcctgagagttggcaaaggcgtgtgggctagactgtggctgaagaactggaagcggttcaagctcaaaaagaaatacacaggcatggaaatcctgctgtggattctgctgaagatggaaattcagatcttcaagatttgcctgggcgagatgcagctgtgcctcaagaagaaagtcaacgcctgcagcaacgccaagaaaatgcccttccagtgccggtgcagacgcgagtacagagtgaccatgattcagaagaagaaacagaagtccccgctgttcttccacggcgacctgtgcagaccttctccttgcctgtcttggagcagcaggatcgtggctcctggacacgccctgagctgtcggactcgtagaagatggtccagcaagatggccaagaagtcccagcagcctctgtgtagaggcggcccttctgccagcgatagatgctgtagctgtagccccagcggctttagcgctggaagaggcagatgtcctgtgcagggatgtctgaggccacacagagttcagctgctgagaagatggggccctggatctcctgctggccagagactgtctaagggcttccaactgctgcgttggtggggaccaggatctccagctcctgagcctagaaagggcccatttccaccacctgatcctccatggcctgtgaccgctgtgacagtgatggctggctctgtgcctagcgctcagtctgtggatgctctggaatcccctggacctctggctctcgaaggccctagcagccctagaaacctgctctggcgggaaatgagcatcttcctgcctggcatcttcaacctgcacctgtgctactaccacagccagagcaaccggaacaagagccggcagatggaatccctgggcatgaagctgcagatcacacacccattcgccagccagccactgggccaagagatgcccaacaacacccagatcagactgctgaagcccggccaggcctttggcagcttttccgccgatttttcagcccctcagcaggcccctctgagactgtggtcttggtgcggcacaagccagacctacttcggctctatcgaagccctgacagccctgttcacctgtagaaccgccagcatcagcgtgaacatcagcaccctgatgagcatcctggaagccatcctggccatgacactgaccctgaatggcagccctctgtgggactgcagcacaacaacaggcacacaccacggctgcctgtgggagatcccttctgttaccctgctggctaccgccaaaaagagccctaccagcttctgctgtcagcggcctcctctgcagccagtggaagagaagaagaacggccggatcagcagcgtgccaccttctccacctcttgctctgggccctagaatgcagctctgcacccagctggcccggttcttccctattacacctcctgtgtggcacatcctgggacctcagagacacacccctctgctgacccctgacaccagatggatcttctccaaccagctgcagaccgtgcagatgctgtgtctgcctccactgaagcagggcgagagaatcatctggcctctcggcggctttcagatccccaacttcttttggagcctcggcatcggacacactggcgcctggtggcatactggaaggcggagaagagaatggggcggcagcaccgtgtctagaagcccactgtggatcagctccatgatctacctgagaggcatggccttcgcctccgacagcagcatcagaaccaccagagtgtcctggtgtcggagatgtggcgccaaaagcgccgcagccagcagcgacaagaagaagaaaagcaccgaaaagaccaagaacaagatcatctgcaagggccacagaatcacccaggtggtgctgagactgggcaacctgcctccattcttcagaggcagcgaggtgccctttcctagaccttgccggaccaagtgccagaagaaggttccaagcgcctctccttggggactgcacccaagaacagcctccatcacactgcctaccaccagcctgaagggcagcagaacaagctgctgccccagatctcaccccagactgcccagaacaaagtggcctctgcagtgcctgctgcacagcctgggaacaactggaacactcgtgtgggaaaggggcgtgctgcagatgagaagtctggaagctcactgccctctgcagacattccacctccaccactgcagaacccagcctagctcttgtcctccagcctggattctgtaccaaggacagtggagcggagccgtcgtgggacttagacctgtggctcaccatctgccaagacctatccaggggctgcactgtcctcaggctcctcatcaaccagctctgtcctggggaaagtggcccgtgggaatgacaggacccgccagatgttgccggtggcctagaagaatgtgtagctctctggccctgccaaccggcctgacatctctgatcctgcctagcagtgatctggccgtgctgatctctagctccaccagccactttctgatgcggagcccagtgctgccaagcagcagactgacatgtgcctctccacagctgcctcggatgtggacatggtctagctggctgaaagagtggggaggacaggcccacagacagcggaactgtagagtgaacgccgttgaggaactgcacagcaggcggatgtctgtgcggatcgtgaagaattgggtgtcctgctgttacgtgcggctgagtgcagtgggactgtctacttggagcgccctggattccctgatcctgtccttccagagagtgaaaaccagccggatactgaacctccaggtgctgaagaagatcctgcggagctttatgaagctgtaccactctctcgtgatgtgcctgcggctgcggaccaagctggaaaaagctctgagcgctctgtttatctggccccagcacagctacaaaggccaggcattcggaagcctgtgccagctggtgtctgccgatttcagcgcccctcaagtgaccagactgcggagcctgaaccatctgctgattcggtggatctttagcaatcagctgacagtccaaatgctctgcctgccgatcatcaagaaaatgaagaaacggatcatggtgcacgtcttgaagaagaatcggaagcagattatctgtatcaagaatatgttcctgcagcggaagggattcctgaacctgagccacgtggaaaagttcagagagagcaccctgggcaatttctggatgaagctcctgcagctgccaccagcttgcacctctaaggcctggacacccagaaagcttgtggggagagccgtgcggagaaagggcgtcgtgatcaacctgaagagactgcagaaattccgggctagcgtgtccttctggactctgctgcctacaacaggcgtgcggacaagaggctctccactgagactgactctgtggcctccaagaagccagaaaagccagcaccactgcgccctgagaaagatcgagtgggccacaaagctgtccctcggcggcaaagcaggaccacaggctcaagagaaggccaacatcctgaacagcctgccttcctctatggaaatcgccgtgctgcaagaaatgctgaaccagaagtgtctggcccctttcgagcttaagaagaacctcctgctgccaacctacacaccccacatctgtcggcacacccttaaaaagaagcccagagacatctgcagaatcagcggctacccctacgatgtccctgactatgcgtcctaaaggcgcgcctagcggccgc

SEQ ID NO: 1207 - DNA, 4690 bp, Artificial Sequence
  Cloning cassette hTPA 1D
gaattcggatcccgcgacttcgccgccatggatgcaatgaagagagggctctgctgtgtgctgctgctgtgtggagcagtcttcgtttcgcccagccaggaaatccatgcccgagccgacaagaaaaacgtgcggagcgctagttctcctggacatcctcttggccccagaagaatgaccagacggaccatgaccaccaccaaaatgatgatgatgcggcggaccaagcggcggagaagaaaaagacgccggatgaccatgatgaccagaagaaccctgctgaccaagaaaacctgtctgacccctagaaccagcgccgccacaaaagctctgcccagacagacaatcagccagcggaggcctatccagacacctcctggaacaagcctggccatctggggcagaagaagcaagatcgaggcctctcctatcggcagcatcacccctctgagcatcagcagacctaccagcagagccagacagagctgttgcctgcctggactgacacaccctgctcatcagcctctgggctctatggttggagctggaacaggcggaggacctgcttgtgtgcctgtggccgaagcttctacaggcgcttggacagctgaaggcgctgccggcacaagatgtagagccagcagagccccttgcagacagctgcctgcttctagccctaccaagtgcgagatctgcgtgaagagaagaaggcggcgcaagcggagcagccagtctagatctcccgtgcctaagaaacgcgagcggatgatgctccctgtgcgggccagaacagctagatctgctctgccacaaggcagggctcctctggaaggaatgcttctgcctagagcactgcccagcctgctgagcagaatgcctgccagaagagagagcagattctggctggccctgcaggcccttggactcagacctcctcatctgcctagctgtcaccctctgcctcaactgcttggacctcctccacctcatcaggcccctggcgagaaaaacgacctgcagctgttcgtgatgagcgacaccacctacaagatctactggaccgtgatcctgctgaacccctgcggcaacctgcacctgaaaaccaccagcctgaacgccaagaaaatggaagatatgatctgggagagcaaccagcagctgaagtggacccctcacatcctgaagtccgcctctatcgccaagaagcggatcaagctgcggcggaacagcaccagacgggaaatgccttctcaggccacaccttctccacctggaccttggagagccgctctgggcaaagaagtgaagcggagccagagcaagctgagactgagaaacacaagccccttcgacaaaaagggctttgtgatcctgagcaacatgggcggcaaccggtctatctgcctgaccatcgtgttctttctggccccttacttccccatgcctagcagctggtctagcagcggcagaaccagactgcctctgaggccacagagaggccctagacctctgcatagatggctgcagcagaccaccggctgctctcagagaagaggcgactgcccaagaaccatggccggaccatctgcttctctgcaccctgcatctggcagagcctccagaaagacctggcagagaaggctgagagcctgtagagcaggcggacctgctggatgggctagacaggccagaaaacgcaagagagagaagcggtcccagaagtccagacagaaccatctgcagctgaaaagctgcagacggaagatcagcaactggtctaagctgcggagcccctggatcttcgaggccaaaaagagcatgaagagatcccagcggcctcctcggagcatcctgagcctgttcaagaagaagaagcccctgacattcagccccagcgtgtccaagaagaggctgcctaagctgaagggcaagaaacgccggaaagaaatccagcggaaggtggtcaagaaccccagccagcctgtgccactgagaaatgacggcatcaccaacggcaacgacagcacccggtcttgcagcatcagcctgaagaaaagcctggaaaagatgcccctgatgcggagcctgctgtactccagaatgtgcctggtgcagatccccacacacacctgggagcccgactactttgtgtccctgcctatgatgttcagctgggccacacagagctttccagtgggcgccgtgtttctgaccagacctgccattccttgctgtagctgtaccagccactccaatccttggagccagtccacactggccatccggtttatctctgcccctcagccaagcagcagcaccgttacagctgctcctagcggccagtattttgccctgcggagtatgcccaagagccggaaccaggtgctgtttcggagaaatctgaccccaagccagctgcggacactggcccctccatatatgctgctgcctcagtctctgtcccagagcctgtctcggaagcagatcccatctcagtccatgctcgtgcggaccaggctgacactgacaggcactagaagctccggcaccagagcctctccatctgccgtgtgtctgtgctgctggacatgccccagcagaagctttcctgccgcctctccaagcggactgagagcacctgttggagcacaggctcctccagaagtgacactgagagccagctgtgccagctccgccagcaaagcttgtgcaggactttggccttggggagcccaagtgcggatgaagaagaaggacagcaccatcttcatctaccccaggctgaaaaccttcggcgtgccactgggcagcattctgtgtctggctggaagcctgagcacgatgatgatcattagcaccaccagacaagagtgcggcagacgggccagcgtgccctgtagacctatgatcggaagcgccagacctggaccatggcggacaagtgctatgccttctgccatgggagtcgccctgcctaccagctgtgaaagcggaagatctcctcctgccaccggcggaagaatgccaggatctcagtctatcatgatgagctggatgcctccactggctccctgcgctgcttgtccttgttctcctgctcctacactgtgccctgctcaccctgctagagcaccaacagccgtgcctgcctttacacccctgtctgctcatcctgtgccagtgctgtctggatgtcacctggctgtgcggacctccatgcttaccttgctgccaatgatgaccctgaaggccctggtcaagacatggacccagttcagaaactaccccagacggcaccctcacagaagcccaccaacaagctgtcctccactgctcgaggcctttccactgccaagagccagcctgagagctaccgtgcctagacactctagcgtgctggccacaggactgcatctgcataggcagattagcctgcctctgcggggcttcctgctgcatcaaccactgccaggacaacacctgtggctgtcccacagactgagactgcggctgcctagaacaaccgagatccagctgaccatgaacgactccaagcacaagctggaaagccccgctctgaaacaggtgtccccagctagtcctcctacacagcagcctcagacaccccaggattctagacaggtgctggccgtgcctatgagcctggcctgtagcatcaccgtgtccttcgtgggccagatctctaccctggtgctggacgtgtcctccatcagccactggaacggcatctgggaagtgatgcccagaacactggaaggctgcatctccgtgaaggaccaccggacatcccagaaccacagcaagtgcatcaccgagtgtgtgcggacagccctgaacaccaagtgtgaaatttgtgtgaagaacaccgccatcctggctatcaccctgatcaccccacaggaccctcacctggaccctgtgtgtcatccccatagaaggcccggctggaagggacaccacagagtggtgtttagccaccatccttccggcagcaccaagtctcactggcagcagagagaaagaggcggaggccgcagagaaaagaagggctgtagagaggcaagcagagccggccagtttcctgtgtggcggagaacatctagaggcatgtccctgcagtggaagtccggcaatgcctgcacacctctgagatgtcccagcagatctccagccaccttcctgactgccctgaacggctggcatagatctggactgagggcccagaccgccttctttctgctggacatcatcctgcggagagcccggcctacaagctgcagcacatgtagaatgtggtggcggctgccctgcaaagtgaccgaaagctccctggccaagaaaaccctgaccaatcagcctagcttgcccggaccttgtgctagcctgctgtctacactgagccagccaccacctcaggctcctagccaagtttggacagccgctacactgcggtgtcctgctgtgcctgctgctgcatgtccacctctgaagctggctccactgcaagtgaccacaacactgaagctgatcctggtcatgctggaaatcgtgaccgagaacaaagttcggcagaacttcaagcggaactccagcttcttctacaccagcgacagaggctacccctacgatgtccctgactatgcgtcctaaaggcgcgcctagcggccgc

SEQ ID NO: 1208 - DNA, 4672 bp, Artificial Sequence
  Cloning cassette hTPA 2D
gaattcggatcccgcgacttcgccgccatggatgcaatgaagagagggctctgctgtgtgctgctgctgtgtggagcagtcttcgtttcgcccagccaggaaatccatgcccgacggaagatgcagagcctgaatcaccccagcagactgaccaacaatcctcggagaaagacctggaagatgcggaagaagtacgcccagaagcctagccagaagaaccacctgtaccggcagatcaaccggcgcaagctgcagagaaagaagtccagaagccacctggacttcagcccctactggatgaagaaagtgaagcgggccagaaaccggaacatgaagaaaaccatgagccacctgatcgcccatcaggccctgaagatgtctggcctgagactgtttcaccccagactgctgaccagaaagaagcccggcaagcagaaaaagggccacatgatcttcagccggcggaagtggcagatccggcacgtgctgaagaatctgatccccagcctgaacgcccagtggatgttcctgagaatcgctagcccacagatcatgcagagaaccagcgccgaccggttccggatgaagcggagaatgcagaacctggacaatctgggcgtgccctggcctctgttgcctggattgctgctggcccatatgtacggcttcagcacctacggcacccagaaaggcgagtgcgtgtgtctgcagtgtctgagcggcagcagcctgttcatcctgaagcagcccctggacctgaagatctccaagaccttcatggccagccctcagattatgcagcggatgagcgccgtgaacttcgagacaatcctgcaggcccatcctcaggtgccagctcttgctcctcaagcttggtggcccgctagaagaggccctctgacatctgctccaagcgcacagcagtccctgacacggacactggaaagcgccggactgtttccttggctgcacacccagtgccgggccttcattcacacacctagaagccctggctgcagcgtgtacgccaacatgtgctggcggtacaagaaacggggagtgatcgcctggcggatctaccctcctagcacatgcagcctgccttgcagaggcctgatcctgattcagcacggcggcatcttcaccttccggttctgggtcgagaagctgagctggaacatctgcaagaacctgagcctgtacctggataagttcgtgcagcggctgctgtacgtgtacatcatcgagacaaacgtgttcgtgctgaacctgttccacgtgccagtgaaccagatcttcatgatggccttctacctgaagtacaccgagaaggcctgggtcatggaactggaatggctgatccagcagcagtgctaccagcggaagagaatgaagaccggcgccatccaagagaagggcgctattcaagagaaaggggccatgaccaagcggatctgcgtggtcaatttcgaggcctgcagagagatggaaagcctgagcgcccctgagaagatcaccctgtttgaagcccacatggcccggtgcaccagcatcaatgtgctgtgtgtcagggccagcctgatcgagaaactgatgaaagaaaagcgcaagatgaagcgcaaccaggtggcatcccctcaaatcatgcaacggctgttcatcaagggctaccagaacaaccacttcacgttccacctccaaaacttcgccttcttcagctccttcggcaacaacaagtatatcaacatcctgacctttctgcccagcagattcccttggggacctcctccactgggagcccttagagctacagctcctgctacagctgctccccaggcacagacacctcattggagagccgccaccacaagcagcatgagcagctctccaagagccgagcctaccagctctagctcttgggccacttgctggcctagatgctgcagctccagctgctattggagcctgtctagctggcctcctgctggcgctgccgaagccacaaataccagaaccagaagccgcgagagccagcggggaagaatgctgacttggagaagctccctgtggctgcagggcaccagatgttttacaggcgtgcggaccagctccaggtgcagcctgatggaacagatccctcacctgaagtctaacagccggaagaaactgctcgaggacatgaagcagaacggcttcaccagacggcggaacagcagaaagcagagccaagtgcagctggccatccaggtgctgctggtggacaagcacaagtactttctgttcggcagagccacatttctgctggctctgtgggagtgtagcctgcctcaggctagactgtgcctgatcgtgtctagaaccctgctgctcgtgcagtctagacacccaagctggccttggaccagatgcctgagaatgcggcctccacgcagccactggaactctgcctacctggggagaacactgctcgtgacctgcatcctgtaccacagatggatcgtgaccagcatgtgccagagccagagatggctgacctccaccacctctagaagctctgccctgatgtggacctggtggtgtacaagaggtggcggcaagcggaagaaaaagatgtgcaaggtgtccggcggctgcaccgcctgtgttgaaagatgtccttggaagggcatctgttggaagtggcctgtgacagtggccgccatgagcagaacacctccaagacgcgtgtgcggccacagagagggcagcgagtctgataatctgggcctgctgtactcctttccacctgtgctgttcaaggccgaccagagcgaaagctctctgagcagcggcaacagcgtgatcgtgcacaagatcgtgctggtgttcctgaagtccctgagcagctacaactgcgagagaagaatcagcggcatccagaagagagccatcgagttcgccgtcctgaagctgctgaacatggacctcggcaagggactgacacaccccgtgcctctgaagaggaccctgcagaacaagcggaacaagaacatcaagcgggtcaaccagaagaagggcaacatcaagaggaagtccatcctgctgcatctgattgtgctgaacagccccgagagcaaccgggaaaagatcatcaaccccaccatcagctgcccctttcagagccccacaaagagactgggaagccctcctctgcacctgtgtcagcctctgaggccctatcctatcagcgagggcctgaccatgaccaccggcagaaacatcaacagcaactccctgatgaccaactgcctgttcagccccatcttcctgtgccaccacgccatcatgcaccggaagatgacaagccctcacttcagactgttctccagcaagatcccacatccacaggtcccaagtgtggtggccctgtgcaagtttacacacccctgcaccatgctgctgccccaaggcgctttttggaagcctcctagccagggcatctccagctgtctgatgacaggctgttggcagtggtccagcgtgacaagcctggaatggacagcccaagagagaggctgttcctcctggctgatgaagcaaacatggatgaagtcttggtccctgcgggaccccagctacagatccatcctggaatacgtgtccacacgggtgctgtggatgcccacctctaccgtgcctaagttctttctgaccttcagccagatccggatgtgcgccctgtctcaccctagcttctacatcagctccaccgtgtgctttctgagcaagcactgcatgaccgcctgcacacctggaaccagcctgcagtgttacctgaacctggccaacggcctgtggttcaacctgatcttccggaacaaaaagaccaagctgtggttctccctgattaacatccaccaccgcaagaacccactgctgcccatgcggctggaaaaaaaggccacttggatgcggcggaccgagctgtctctggaaccttggattccttacctgcatcagcagaaaacccagtggctccccatgagaagcctgggcgagccttggcgagctggatttcagtggggagagtctccctggcaagtgatggcctctctgacaggcagacgcaagaaaagagaggatcactgcggactgcaagagaaaaaaagccggaagctgatgtccagctgcgccgctcctccacatagactgctgggacctagcagatggggaagctgtgggagagcctgttcttgtggcagaggctgtggaacccctagaggcgactggaagagacacccacctcggcggattctgtttcacgtgcggaacatcgtgtacggaatccaagtgatgctgtgctgtcaccccgcctggctgtctccaatcagcgcttgtcctcgcctgctgccttatccattccacgttctggccctggaagtgacattccctccaggcactgccatgcctcagatgcaattgcaggcactggcaatgtgggagaaaggctgggacaagcctctggaaaacacacagatccccaggacaagcccactgtggaagatcacaatggtgctgacataccccaactgcgtggtgcacgtcctgatgttcggcggcaagaagcggagcaagttcggctacccctacgatgtccctgactatgcgtcctaaaggcgcgcctagcggccgc

SEQ ID NO: 1209 - DNA, 4687 bp, Artificial Sequence
  Cloning cassette hTPA 3D
gaattcggatcccgcgacttcgccgccatggatgcaatgaagagagggctctgctgtgtgctgctgctgtgtggagcagtcttcgtttcgcccagccaggaaatccatgcccgacagaacaccagaagcaccaacctggaaaagaaccccagcctgaagaagcagagccagcggagaggaaagctgagcagcagaaagaagggccacaccaagaaccggcggaaggccaagagaaagccccagatcagccagaagaaggaccctgccggcaagctgaagaaacacctgaaccggaagctgcacctgaccagatcctgcctgatcgacctgaccatgatgatgagccagaagctgtggaagaaccagcgcaagagaatccctctgccttctccacggcagcatctgctgcctcagtatccactgcatcctccacctccatgcctgctgctgctccaccacagacaccatctggcctttctcgagatggcctgcagcagccagcacacccacagcatcaagatctggatcagcttcagccacgaggacctgcctagaatgctgcccatcagcagccctctgcacagaccccagatgcctttctggacctgcacctttcctgccaccacatggggcacatgggagacaccttctacatggggctggcggacattcggccctgtgtactacgtgtgcaaccggatgaacgtgtccagcgtgctgaagcctttcctgttcaccgtgcctatcgaggacatgagagagtgcaccctgggcagaaacagaatgaatgtgtcctctgtgctgaaaccctgtctgatccccgtgccaatcctgaccacactgagcttcgtgctgatcgaggaaagccggcggaacagacggtacagaaagatctacggggagctgaagatgtccctgcaggccctgcctctgacctttagcacactgctgtgggacagcagacacaccaccaccacaagcagccccagaagatcccctgctctgagagctagaggcggcaccacaatcggcgaagtgacaagcagaggcgccagcagctctaccagcagagacagcagaagctttttcaccagcgctcaccccagcagaccctgcagaatgagactgtaccagagcaacggcatggaagcctgcggcacacaccctacacctagactgtctagaggccctccactgcacaccagaaccatgagcctgagcaacatcctgatgaagttccggctgatgctgcagaagcagtgctgctacaacctcgtgatcaagcaccctctgatcttccggatcaacctgcggagacagggcaagaccaaagacggcgttgtgcagagcctgggcttcctgaaccagcagatcatcctgcagaaagagttcttcatctgcctgctgatgttcatcaagcggtggaagccagccgccacaaagacacctccaccactgattctgtggcctcaggccgctcctgtgcacaagaagagaggcctgttcagcctgttcttctcccactgcctgtgccaccagatgaagtgcctgaccgccgtggattgtctgcaggccttctgggacatgatgattcgcaagatccagaagcggcggagaaccgccaaccggctgaaaaagaaatacctggtgcagtgtaccaacctgagcgtgcccatgatgctgaccatcctgatctggaagcgggtgttcatcctcctgctgagcgacaagaagtgtctgagagtcagatgcggcggatggctgtgtggctggacacctagaggcaagaacaagaagcggagaaagctgcggcccaagcacctgaagaaaaccagcgccaaggtgtccgtgatcaccatgaagctctgggagaagcacttcaagggcctgaactggaacctggtcgtgtggattctgaacctgaagatgatgtggctcaagaagtccaccaagagcagacagagcagcccattcctggctcggagctggaataccatgcaatggaacaacaagaaaatggccatgaccgtgatcgctggcgcccaccactgtcagtacaagctgacctacaccaaagtgtggaagatgaattggaagaaaatgatgatcggctcccagcacctcctgtttagcccactggattcaagcccactgcagttgctgctgcaccctcacggcaagagatgcaacccttgctgcagactgacctggatgagcagagagtgggaaaagcggaagcagatcctcggcggaggcggcaagtacaaagagtacttcctgaagcggattctcatccggaaggctatgacagtgctggccggcgataagaaaggcctgggaagattcatgagatgcgtgcagagcgagacaaaggccgtgtctctgcagctgcctctcggccgaagaaagtccggcgtgatgaagtgttgggatctgtgccccagactggactttcaccccagatctagctctggcggcgagaagctgaagcactgtttcaaagcctggggcctgtgcttcttctacctgctgtacttcgagaagaaacggcccgagtggctgagcgttgaccctcctggatctgtctggattctgccctgcatggacctggacggaatgctgacagtgatcggccagggactcgtgggcatgacccctagagatctgggaacagtggctggcgccaccgcacagattcagaggcctatccaggtgcagacaggcggcagactgttcctgattcacctgagaaaggtggacacccaccatctgcaggtcgtgaccaagaccgtgacagccacaacagctgacggccagaggatgcggagactgaagtgcaaggcctgtcggctgagatgggccagacctgaacctgctgcacaggctcctccaaagagccactttccacctcatcctagcggcccctccagaacctctagcctgcagctcagacccattcctccacacctgagacacccactgctgctgaagggaaagaacagcccctgctgccaaaagaaactgcgggtgcagaaccagggccatctgctgatgatcctgctgcataacgccagacagcccagcaggcctaccggaagaacccctaccacaagactgatggcccctgtgggcagcgtgatgtcttgtagcctgctgacccagccatctcctgccagcgcatgtacaatgccaccactcctgcatccacagtgggccccacatagtgctggactgtctccaggcgcttgcagacctgcctgtacctgcatcagcatgaccaccatctccagagccacatggcggctgagaatcccaagcctgaggaagtaccggcagaacatcgagatcacccctcagcggtctaaggcccaggtttccgtgtacagcggcaatctgctgagcttctccagacggggcatgaagagtagcgtgcggctgaagaacagcatccctcacgtgccaaaagccaccgccgctcactctgtgacagtgaagctgcagtacctgtttttcctgaccgtgtgcggcttcgaccgggtgttcctggttaagatctgcaagaagaagctgctcctcaagctgctgagaggccccagacggaaagtgctgatggtgctttggctgcccgccaaccagagtctgcagaaaagccaggtgttccagtgggtgctgcggaccgaaacctacatggaaatgcactacggccatcaggcccctcaggtggccatgctgcctaaactgctgtgtagacagatgctccccactctgtccacactccagcagaggcatcctcagggaccttgtcctcctcctgtgacacctctgagagtgcagtctgtgctgctcctgggagtgcctcagacagccgcttttagcggccggattctgcaccagccagaaatggccgccatgagactgatgcccaagttcctgaactccaccaacagctggtggacagtggcccctagatgtcctagaagcgccgtggacattagccccggacctacatctcctagcctggcctcttgtgcctctgtggccattggaaaactggcactgctgggcgcatctgccccttgtggcgcagctggtgctagagaggctggaagatttgccgtgctgggcaccatggttatgaagggtgctgccgcagcctcctgtcagtctcctccatctccaagagagacaacccctagcagcgacgccaccagacggacaagacctattgccgctcagagcaaaaagaccatgactgccgccggactgacccctcggagaaacctgcagagaaatctgaaggtcctgggcgccaagaagatcaccttcctgagaaacagcagacgcgccacacctacctctaagggcagcctgagaagaaagtacctgagagtgaacatccgcaagctcatctggaccaagcagcggagcttcctgtctctgttccccaagctgagagccaccgagcagatgaccaatgtgggatgcctgctcaagaaaagcagccaattgcggcggagctggcgcaatgtgtcccggatcagcaacatggaacacaggctgaccatggacagcgccctgagcctgacaaagagagagggccctgagacaagcgagaagaagaggaagttgcctggctacccctacgatgtccctgactatgcgtcctaaaggcgcgcctagcggccgc

SEQ ID NO: 1210 - DNA, 4690 bp, Artificial Sequence
  Cloning cassette hTPA 4D
gaattcggatcccgcgacttcgccgccatggatgcaatgaagagagggctctgctgtgtgctgctgctgtgtggagcagtcttcgtttcgcccagccaggaaatccatgcccgaaacagaaagaccagaaaggccgccagagagaagcaccgcaagaccgacgacaagaagaagaagtccaccgaaaagaccaagaacgccaagaagatgcccttccagcagcggcctcctctgcagcctgttaacctggatctgcagcaccagcgcagacgcaaaaagaagaaagacaaggtcgaaatccggaatcggagccctaaggccaatagcaccgagtgtcagggcgagcacagcagagagcagaacctgctgaatctggtgcagctgaaccctcacagccctcaccacagaaaggacgaagaggaccaccagaagcggcaccaccaccacaatcaaaagaaaatgagcgtgcgggctagcgtgtccttctggacacttttgccaacaaccggcgtgcggacaagaggctctccactgagactgacactgtggcctccacgggttccaccttctccacctcttgctctgggccccagaatgcagctgtgtacccagctcgcccggttcttccctatcacacctcctgtgtggcacatcctgggacctcagagacacacacctcaggctcctctgaggctgtggtcttggtgcggcacaagccagacctacttcggcagcagaccatctccttgcctgagctggtccagcagaattgtggcccctggacacgccctgagctgtcggactagaagaagatggtctagcaagcggtggatcttctccaaccagctgaccgtgcagatgctgtgcctgccaatcacacacccattcgcctctcagcctctgggacaagagatgcccaacaacacccagatccggctgctgaagccctgcagagtgaacgccgtggaagaactgcacagcaggcggatgtctgtgcggatcgtgaagaactgggtgtcctgctgttacgtgcggctgtctgctgtgggcctgtctacttggagtgccctggacgaggaaaagaagaacggccggatcagcagcctgaaaaagaaagtgaatgcctgcagctccctgatcctgagcttccagcgcgtgaaaaccggcatggaaatcctgctgtggattctgctgaagatggaaattcagatcttcaagatttgcctgggcgagatgcagctctgcggccaggcctttggaagctttagcgccgatttcagcgcccctcagatcattaagaagatgaagaaacggatcatggtgcacgagctgaagaagaatctgctgctgcctatgtgctccagcctggctctgccaacaggcctgacatctctgatcctgcctagcagcgatctggccgtgctgatctctagctccaccagccactttctgatgcggagccctgtgctgccaagcagcagactgacttgtgcctctccacagctgccccggatgtggacttggtctagctggctgaagaacgagggcaacaaccactggcctagagtggaaatgcctaccggctggctgctcgtcggctacaacaccagaaacacagcccagaatcctcggctgcagcagcacctgaaacactggcagcagtgcaccagagccagatggtgtcaagagccctgtcagaccctgaccttcttccatttcttcttctttttcaaaacggtgtccctgtgttgccccggctggtctaaaggacaacctcctccacctggcctgaagccttctagcctggcttctcaggtggccagaaccacaggcgtgtaccagcacgtgtggctgatctgtttcgtgtttttcgtgtgtgtggaaaccggcttctgtcacgtggcccaagtgggactcgagagactggtgtctctgtccggcatcaccgacgtgaaccattgggcccagcctaagccatctcctagcaaaggcaccggcatgaacagacccatcggcctgagagttggcaaaggcgtgtgggccagactgatcctggccatgacactgaccctgaacggcatggccaagaagtcccagcagcctctgcaggtcgtgctgagactgggaaacctgcctccattcttcagaggcagcgaggtgccctttcctagaccttgtcggaccaagcctgcctgcacaagcaaggcctggactcccagaaaactcgtggggagagccgtgcggagaaagggatctccactctgggattgctccaccacaacaggcacacaccacggatgcctgtgggagatcccatctgtgaccctgctggcccatcctagaaccgcctctatcaccctgcctaccacaagcctgaagggctccagaaccagctgctgccctagatctcaccccagactgcctaggaccaaatggcccctgcagtgtctgctgcacagcctgggaacaaccggaacactcgtttgggaaaggggcgtcctgcagatgagatccctcgaagcccattgtccactgcagaccttccatctgcaccactgcaggacccagcctagctcttgtcctcctgcctggattctgtaccaaggacagtggagcggagccgtcgtgggacttagacctgtggctcaccatctgcctagacctatccagggcctgcactgtccacaggcacctcatcaacctgctctgagctggggaaaatggcccgtgggaatgacaggccctgccagatgttgcagatggcccagacggtgccagaagaaggttccatcagcctctccatggggcctcgtgctcaaaaagaaccggaaacagatgctgaaccagaagtgtctggccccttttagagagagcaccctgggcaatttctggatgaagctgctccagctgcctgtcgtgatcaacctgaagagactgcagaagttcaacctgcacctgtgctactaccacagccagagcaacagaaacaagagccgccagatggaatccctgggcatgaagttgcagtcccagaaatcccagcaccactgtgccctgcggaagatcgagtgggccacaaagttgtctctcggcggaaaagccggaccacaggctcaagagaaggccacctctcggattctgaacctgcaagtgctcaagaagatcctgcggagctttatgaagctgtaccactctctggtcatgtgcctgcggctgaggaccaagctggaaaaggctctgagcgccctgttcatctggccccagcacagctacaagcccctgttctttcacggcgacctgtgcgagtggggaggccaggctcatagacagcggaactggctgaaaaactggaagcggttcaagcttaaaaagaagtacatccagaagaagaagcagaagtctaacaagatcatctgcaagggccaccgcatcaccatcatctgtatcaagaatatgttcctgcagcgcaagggcttcctgaacctgagccacgtggaaaagttctgtagaggcggccctagcgccagcgatagatgctgttcttgtagccccagcggcttcagtgccggcagaggaagatgtcctgttcagggctgtctgaggccccacagagttcaactgctgagaagatggggccctggctctcctgctggacagaggctgtctaagggctttcagctgctccgttggtggggaccaggatctcctgctcctgagcctagaaagggcccatttccaccacctgatcctccatggcctgtgaccgctgtgacagtgatggctggatctgtgcctagtgctcagtctgtggacgccctggaatctcctggacctctggctctcgaaggacctagcagccctagaaacctgctttggagagagatgagcatctttctgcccggcatcttcaccgccaagaaaagccccaccagcttttgctgcaatatcctgaacagcctgccaagctctatggaaatcgccgtgctgcaagaggacagcaaaaagatgacccagaagggccaagccttcggctccctgtgtcagcttgtgtccgctgacttctctgcccctcaagtgacccggctgcggagcctgaatcatctgctgatcacctacacaccccacatctgcagacacaccctgctgacccctgacaccagatggatctttagcaatcagctgcagacagtccagatgctctgtctgcctccactgaagcagggcgagagaatcatttggcccctcggcggctttcagatccccaacttcttttggagcctcggcatcggacacactggcgcctggtggcatactggaaggcggagaagagaatggggcggcagcaccgtgtctagaagccctctgtggatcagctccatgatctacctgagaggcatggccttcgccagcgacagcagcatcagaaccaccagagtgtcctggtgcagaagatgcggcgccaaaagcgctgccgccagctctattgaagctctgaccgctctgtttacctgccggaccgccagcatcagcgtgaacatcagcaccctgatgtccatcctggaagcacttaagaagaaacccagagacatctgccgcatcagctgccggtgtagacgcgagtacagagtgactatgggctacccctacgatgtccctgactatgcgtcctaaaggcgcgcctagcggccgc

SEQ ID NO: 1211 - DNA, 5299 bp, Artificial Sequence
  Cloning cassette hINV 1C
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgagcaccagacgggaaatgccttctcaggccacaccttctccacctggaccttggagagccgctctgggcaaagaagtgaagcggagccagagcaagctgcggctgagaaacacaagccccaccgagatccaattgaccatgaacgacagcaagcacaagctggaaagccccgctctgaaacaggtgtcccctgcctctccacctacacagcagcctcagacaccccaggatagcagacaggtgctggccgcttcttctcctggacatcctcttggccctggcgactgccctagaacaatggctggaccttctgcctctctgcacccagcatctggcagagccagcagaaagacctggcagagaaggctgagagcctgtagagctggtggacctgctggatgggctagacaggccatgacactgaaggccctggtcaagacctggacacagttcagaaactaccccagagtcggagccggaacaggcggaggacctgcttgtgttcctgtggccgaagcttctactggcgcctggacagctgaaggcgctgccggaacaagatgcagagcttctagagccccttgcagacagctgcctgccagctctcctaccaagtgcgagatctgcgtgaagagaaggcggcggagaaagcggagcagccagtctagatctcccgtgcctaagaaacgcgagcggatgatgctgcctgtgcgggccagaacagctagatctgctctgccacaaggcagagcccctctggaaggaatgcttctgcctagagcactgcccagcctgctgagcagaatgccagccagaagagagagccggttttggctggcactgcaggctctgggactcagacctcctcatctgcctagctgtcaccctctgcctcaactgcttggacctcctccacctcatcaggcccctttcgacaagaaaggcttcgtgatcctgagcaagggcaagaagcgccggaaagaaatccggcggatgaccagacggaccatgaccaccaccaaaatgatgatgatgcggcggaccaagcggcggaggcgaaaacgtagaagaatgaccatgatgacccgcagaaccctgctgaccaagaaaacctgtctgacccctagaaccagcgccgccacaaaagctctgcccagacagacaatcagccagcggaggcctatccagacacctcctggaacaagcctggccatctggggcagactgcctctcagaccacagagaggacctcggcctctgcatagatggctgcagcagacaacaggctgctcccagagaagaatcgccaagaagcggatcaagctgaggcggaacacactggccatccggtttatctctgcccctcagcctagcagcagcaccgttacagctgctcctagcggccagtacttcagcagcttcttctacaccagcgaccggaccaagtgtgaaatctgtgtcaagaacaccgccatcctggctatcaccctgatcacccctcaggaccctcacctggaccctgtgtgtcacccacatagaaggcctggctggaagggccaccacagagtggtgtttagccaccatccaagcggctccaccaagagccattggcagcagagagaaagaggcggaggccgcagagaaaaaaagggctgcagagagatgcccagcagctggtctagctctggcagaaccgccgacaaaaagaacgtgcggagcagaaccagactgaccctgacaggcacaagaagcagcggcacaagagcctctccaagcgccgtgtgtctgtgctgttggacatgcccctccagaagcttccctgccgcatctccatctggactgagagcacctgttggagcccaggctcctcctgaagtgacactgagagccagctgtgcctctagcgcctctaaagcctgtgctggactttggccttggggagcccaagtgcggaacaaagtgcggcagaacttcaagcggaacctggccaaaaagaccctgactaacgccctgcggagtatgcccaagagcagaaaccaggtgctgttcagacggaatctgaccccaagccagctgagaactctggcccctccttacatgctgctgccccagtctctgtctcagagcctgtccagaaagcagatccccagccaatcaatgctcgtgaccgccttcttcctgctcgacatcatcctgagaagcctgctgtactcccggatgtgcctggtgcagatccctacacacacctgggagcccgactacttcgtgtccctgcctatgatgttcagctgggccactcagagctttccagtgggagccgtgttcctgaccagacctgccattccttgctgcagctgtaccagccacagcaacccttggagccagtccttcaagaagaagaagcccctgacattcagccccagcgtgccaatgtctctggcctgtagcatcaccgtgtccttcgtgggccagatcagcacactggtgctggacgtgtcctccatctctcactggcgcaagcgcaagagagagaagcggtcccagaagtcccggcagaaccatctgcagctgaagtcctgcagacggaagatcagcaactggtccaagctgagatccccgtggatcttctaccctcggctgaaaaccttcggcgtgccactgggctctatcctgtgtctggcaggctccctgagcacgatgatgatcattagcaccaccagacaagagtgtggcagacgggcctccgtgccttgtagacctatgatcggcagcgctagacccggaccttggcggacatctgctatgccatctgccatgggagtcgccctgcctaccagctgtgaaagcggaagatctcctcctgccaccggcggaagaatgcctggatctcagtctatcatgatgagctggatgcctccactggctccctgtgccgcttgtccttgttctcctgctcctacactgtgccctgctcatcctgcaagagcccctacagccgtgcctgcctttacacctctgtctgctcaccctgtgccagtgctgtctggatgtcacctggccgtgcgcacctctatgctgacactgctgcccatgagacaccctcacagaagcccacctacaagctgccctccactgctggaagctttcccactgccaagggccagcctgagagctaccgtgcctagacacagctctgtgctggccactggactgcatctgcatcggcagattagcctgcctctgaggggcttcctgctgcatcaacctctgcctggacaacacctgtggctgtcccacagactgaggctgagactgccaagaacaggcgagaagaacgacctccagctgttcgtgatgagcgacaccacatacaagatctactggacagtgatcctgctgaacccctgcggcaacctgcacctgaaaaccacatctctgcggagagccagacctacctcctgcagcacatgcagaatgtggtggctgaagctggccccactgcaagtgaccacaacactgaagctgatcctggtcatgctggaaatcgtgaccgaagaggccaagaaatccatgaagagatcccggcggagcaagatcgaggcctctcctatcggctccatcatgaagaagaaagacagcaccatcttcatcaaccagcagctcaagtggacccctcacatcctgaagtctgccagcgtgtccaagaagagactgcccaagctgaacggcatctgggaagtgatgccccggacactggaaggctgcatcagcgtgaaggaccaccggacaagccagaaccacagcaagtgcatcaccgagtgtgtgcggacagccctgaaccagagaaaggtggtcaagaaccccagccagccagtgccactgagaaacgacggcatcaccaacggcaacgactccaccagatcctgctccatcagcctgaagaaaagcctggaaaagatgcccctgatgaacgccaagaaaatggaagatatgatctgggagagcaacatgggcggcaaccggtccatctgcctgacaagactgccctgcaaagtgaccgagtccagccaaagaccacctcggagcattctgtccctggcctctagagccggacagtttcccgtttggcggagaaccagcagaggcatgtccctgcagtggaagtccggcaatgcctgcacacctctgaggtgccctagcagaagccctgccacatttctgaccgcactgaacggctggcacagatctggacttagggctcagcaacctagcctgccaggaccttgtgctagcctgctgtctacactgagccagcctccaccacaggctccaagccaagtttggacagccgccacactgagatgtcccgctgttcctgcagctgcttgccctcctatcgtgttctttctggccccatacttccccacaccactgagcatcagcagacccacctctcgggccagacagtcttgttgtctccccggactgacacaccctgctcaccagcctcttggctctatgggctacccctacgatgtccctgactatgcgtcctaaaggcgcgcctagcggccgc

SEQ ID NO: 1212 - DNA, 5281 bp, Artificial Sequence
  Cloning cassette hINV 2C
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgcggcagatcaacagacggaagctgcagagaaagaagcgccggaagaagagagaggaccactgcggactgcgggccagaaaccggaacatgaagaaaaccatgagccacctgatcgcccatcaggccctgaagatgtctggcctgagactgtttcaccccagactgctgacacggaagaagcctggcaagaaccctcggagaaagacctggaagatgcggaagaagtacgcccagaagcctagccagaagaaccacctgtacggcaagggcctgacacaccctgtgcctctgaagagaaccctgcagaacaagcggaacaagaacatcaagcgcgtgaaccagaagaagggcaacatcaagagaaagagcatcctgctgcacctcatcgtgctgaacagccccgagagcaacctgcaggctcatcctcaagttccagcactggctcctcaggcttggtggcctgctagaagaggccctctgacaagcgctccatctgctcagcagagcctgaccttcctgcctagcagatttccttggggccctcctccactgcactggaactctgcctacctgggcagaacactgctcgtgacctgcatcctgtaccacagatggatcgtgaccagcatgtgccagagccagagatggctgaccagcaccacctctagaagcagcgccctgatgtggacccagtggtctagcgtgacaagcctggaatggacagcccaagagaggggctgtagcagctggctgatgaagcagacctggatgaagtcttggagcctgcgggaccccagctacagatccatcctggaatacgtgtccaccagagtgctgtggatgcccacatctacagtgggagccctgagagccacagctcctgcaacagctgctccacaggctcagacccctcattggagagccgccacaacaagcagcatgagcagcagccctagagccgagcctacaagctctagctcttgggccacctgttggcccagatgttgcagctccagctgttactggtccctgtcctcttggcctcctgctggtgctgccgaggccacaaataccaggaccagaagcagagagtcccagcggggcagaatgctgacttggagaagcagcctgtggctgcagggcaccagatgttttacaggcgtgcggacctccagcagacacccttcttggccttggaccagatgcctgagaatgcggcctcctagaagcaacagccggaaaaagctgctcgaggacatgaagcaaaatggcttcacccggtacaagaaacggggcgtgatagcctggcggagagccactttcctgctggccctttgggagtgcagtctgccccaagctagactgtgcctgatcgtgtctaggaccctgctgctggtccagagcagatgcagcctgatggaacagatccctcacctgaagtcctggtggtgtacaagaggcggcggaaagcggaagaaaaagatgtgcaaggtgtccggcggctgcaccgcctgtgttgaaagatgtccttggaagggcatctgctggaagtggcctgtgacagtggccgctctgatcctgattcagcacggcggcatcttcaccttccggttctgggtcgagaagctgtcctggaacatctgcaagaatctgtccctgtacctggacaagttcgtgcagcggctgctgtacgtgtacatcatcgagacaaacgtgttcgtcctgaacctgttccacgtgccagtgaatcagatcttcatgatggccttctacctgaagtacaccgagaaggcctgggtcatggaactggaatggctcattcagcagcagtgctaccagttgctgctggctcatatgtacggcttcagcacctacggcacccagaaaggcgagtgcgtgtgtctgcagtgtctgagcggcagctccctgttcatcctgaagcagccactggacctgaagatcagcaagaccttcatgagcagatcccacctggatttcagcccctattggatgaagaaagtgaaggcctctccacagatcatgcagcggatgagcgccgtgaacttcgagacaatcaggcggaagtggcagatccggcacgtgctgaagaacctgcctctggaaaacacacagatccccaggacaagccctctgtggaagatcacaatggtgctgacataccccaactgcgtggtgcatgtgctgatgttcgtgctgttcaaggccgaccagagcgagtctagcctgagcagcggaatctaccctcctagcacctgtagcctgccttgccggggcattagaatgtgcgccctgtctcaccctagcttctacatcagcagcaccgtgtgctttctgagcaagcactgcatgaccgcctgcaccagagagaagatcatcaaccccaccatcagctgcccctttcagagccccacaaagagactgggccacagagagggcagcgagagcgataatctgggcctgctgtactcctttcctccttggctgcccatgagatccctgggcgaaccttggagagctggctttcagtggggagagtccccttggcaagtgatggctagcctgaccggcaacagcgtgatcgtgcacaagatcgtgctggtgtttctgaagtctctgagcagctacaactgcgagcggcggatctctggcatccagaagagagccatcgagttcgccgtcctgaagctgctgaacatggacctggctagccctcagattatgcagagaaccagcgccgaccggttccggatgaagcggagaatgcagaacctggataacctgggcgtgccctggccattgcttccaggtgctgctcctccacatagactgctgggcccctctagatggattctgtttcatgtgcggaacatcgtgtacggcatccaagtgatgctgtgccggcggagaaacagcagaaagcagagtcaggtgcagctggccattcaggtcctgctcgtggacaagcacaagtactttctgttcggcccctatcctatcagcgagggactgaccatgaccaccggccggaacatcaacagcaactccctgatgaccaactgcctgttcagccccatcttcctgtgccaccacgccatcatgcaccggaagatgacaagcccacacttcagactgttctccagcaagatcccacatcctcaggtgccaagtgtggtggccctgtgcaagttcctggccaatggcctgtggttcaacctgatctttcagaaaaagggccacatgatctttagccccaagttcttcctgacctttagccagcggaccctggaatccgccggactgtttccatggctgcacacccagtgccggaacaaaaagaccaagctgtggttttccctgatcaacatccaccaccgcaagaatcctctgctgcctatgagaatgagcagaacacctcctcggagagtgtgcggatctccacctctgcatctgtgccaacctctgagaggcggcaagaagagaagcaagttcgccttctggaagcctcctagccagggcatcagctcttgtctgatgacaggctgttggggctcctgtggcagagcttgttcttgcggaagaggctgcggtacacccagaggcgactggaaaagacacccacctcgcagagagctgagcctggaaccatggattccttatctgcaccagcaaaagacccagcggaagcggatgaagaccggcgccattcaagagaagggcgctatccaagaaaaaggcgcaatgaccaagcggatctgcgtggtcaatttcgaggcctgcagagagatggaaagcctgagcgcccctgagaagattaccctgttcgaagcccacatggcccggtgcacctccatcaatgtgctgtgtgtccgggccagcctgattgagaagctgatgaaagaaaagcgcaagatgaagcgcaaccaggtggcatcccctcaaatcatgcaacggctgttcatcaagggctaccagaacaaccacttcacgttccacctccaaaactttgccttcttcagctccttcggcaacaacaagtatatcaacattctcacccgggccttcatccacacacctagaagccctggctgttccgtgtacgccaatatgtgctggcggaagatgcagtccctgaatcaccccagcagactgaccaactgtcaccccgcttggctgagccccattagtgcttgtcctaggctgctgccctatccttttcacgtgctggcactggaagtgacctttccacctggcacagccatgcctcagatgcaattgcaggcactggctatgtgggagaaaggctgggacaagcaagagaagaaatcccgcaagctgatgtcctcctgcctggaaaaaaaggctacctggatgcggagaacccctggcacaagcctgcagtgttacctgaacacacacccctgcaccatgctgctgcctcagggaatcccatctctgaacgcccagtggatgttcctgcggatcggctacccctacgatgtccctgactatgcgtcctaaaggcgcgcctagcggccgc

SEQ ID NO: 1213 - DNA, 5296 bp, Artificial Sequence
  Cloning cassette hINV 3C
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgcctattcctccacacctgagacaccctctgctgctgaagaacaagaagcggagaaagctgcggcccaagagcagaaagaagggccacaccaagaaccggcggaaggccaagagaaagccccagatcagaaacagccgcagagccacacctaccagcaagggcagcctgagaagaaagtacctgagagtgggagccgccgctgctagctgtcaatctcctccatctcctagagagacaacccctagcagcgacgccaccagaagaaccagacctatcgccgctcagagcaagaaaaccatgacagccgccggactgacccctagccagaagaaagatcctgccggcaagctgaagaaacaggtgtccgtgtacagcggcaacctgctgagcttctctcggagaggcatgaagtctagcgtgcgcctgaagaactgcaccaacctgagcgtgcccatgatgctgaccatcctgatctggaagcgggtgttcatcctgctgctgtccgacaagaaatctatccctcacgtgcccaaggccaccgccgctcattctgtgacagtgaagctgcagagccggcggaacagacggtacagaaagatctatggcgagctgaagatgtccctgcaggccagcaatggcatggaagcctgtggcacacaccccacacctagactgtccgtgtccgtgatcaccatgaagctgtgggagaagcacttcaagggcctgaactggaacctggtcgtgtggattctgaacctgaagatgatgctcaagaagaagtatctggtccagcgcgagtgggagaaacggaagcagattcttggcggcggaggcaagtacaaagagtacttcctgaagagaatcctcatccgcaaggccatgacagtgctggccggcgataagaaaggcctgggcagattcatgagatgcgtgcagagcgagacaaaggccgtcagtctgcagctgcctctgggcagaatggacctggatggaatgctgaccgtgatcggccagggactcgtgggcatgacacctagagatctgggaacagtggctggcgccaccgcacagattcagaggcctattcaggtgcagacaggcggcagactgagaggccctagaagaaaggtgctgatggtgctgtggctgcccgccaatcagagcctgcagaaaagccaggtgttccagtgggtgctgagaaccgagctgcccctgacctttagcaccctgctgtgggacagcagacacgacctgcctagaatgctgcccatcagcagccctctgcacagaccccagatgcctttctggacctgcacctttcctgccaccacatggggcacatgggagacaccttctacatggggctggcggacctttgccagacagccttctagacccaccggcagaacccctaccaccagactgatggctccagtgggcagcgtgatgagctgtagcctgctgacacagccatctccagccagcgcctgtacaatgcctccactgctgcatcctcagtgggcccctcattctgctggactttctccaggcgcttgcagacctgcctgtacctgcatcagcatgaccacaatcagcagggccacctggcgcagaaacctgcagagaaacctgaaagtgctgcggctgagaatccccagcctgcggaagtacagacagcagaacacccggtccaccaacctcgagaagaacccatctctgaagaagcagagccagaggcggggcaagctgtctctgaccacactgagcttcgtgctgatcgaggaactgctgaaaaagagcagccagctgcggagaagctggcggaacgtgtccagaatcagcaacatccggaagctgatttggaccaagcagcggagcttcctgtctctgttccccaagctgagagccaccgagcagatgaccaatgtgggctgtagactggattttcaccccagaagcagctccggcgacagagtgttcctggtcaagatccagagcagcccattcctggccagatcctggaataccatgcagtggaacaacaagaaaatggccatgactgtgatcgctggcgcccaccactgtcagtacaagctgacctacaccaaagtgtggaagatgaattggaagaaaatgatgatcggcagccagcacctcctgttctccccactggatagctctccactccagctgctgctgcacccacacggcaagagatgcaacccctgttgtcggctgacatggatgagccacctgaatcggaagctgcacctcaccaggtcctgcctgatcgacctgaccatgatgatgagccagaaactgtggaagaatcagcggaagcgcatccctctgccttctccaagacagcatctgctgcctcagtatcctctgcaccctcctccaccttgtctgctgcttctccaccatagacaccacctggcattcctcgagatggcctgtagctctcagcacacccacagcatcaagatctggatcagcttcagccacgagacaatgagcctgtccaacatcctgatgaagttccggctgaccaccaccacaagcagccccagaagaagccctgctctgcgagctagaggcggcacaacaatcggcgaagtgaccagcagcctgttctttagccactgcctgtgcgtggcccctagatgtcctagatctgccgtggacatcagccccggacctacatctccttctctggcctcttgtgcctctgtggccattggaaagctggcactgcttggcgcctctgctccttgtggtgctgctggcgctagagaggccggaagatttgctgtgctgggcaccatggtcatgaagaacatggaacacagactgaccatggacagcgccctgagcctgacaaagagagagggccctgaaacaggccccgtgtactacgtgtgcaaccggatgaatgtgtccagcgtgctgaagcctttcctgttcaccgtgcctatcgaggacatgagagagtgcaccctgggacgcaacagaatgaatgtctcttccgtgctgaaaccctgtctgatccccgtgccaatctgcaagaagaaactgctgctcaagctgctgaggggcgcctccagctctaccagcagagatagcagaagctttttcaccagcgctcaccccagcagaccctgcaggatgagactgtaccagatgctgcagaagcagtgctgctacaacctcgtgatcaagcaccctctgatcttccggatcaacctgcggagacagggcaagaccaaagacggcgttgtgcagagcctgggcttcctgaaccagcagatcatcctccagaaagagttcttcatctgcctgctgatgttcatcaagcggtggaagccagccgccaccaagaagggcaagaacagcccctgctgccagaaaaaactgcgggtgcagaaccagggccatctgctgatgattctgctgcacaacagaggcccacctctgcataccagattcgagaaaaagcggcccgagtggctgagcagaaaatccggcgtgatgaagtgctgggatctgtgccctgccttcagcggcaggattctgcaccagccagaaatggccgccatgagactgatgcccaagttcctgaactccaccaacagctggtggacagtgcacaagaagagaggcctgttccaccagatgaagtgtctgaccgccgtggactgtctgcaggccttctgggatatgagcgagaagaaacgcaagctgcctatgattcgcaaaatccagaagcggcggagaaccgccaaccggaacatcgagatcacccctcagagaagcaaagcccacctgaagaaaacctccgccaagggcgccaagaaaatcaccttcctgtgcctgagagtcagatgcggaggctggctgtgtggctggacaccaagaggatggctgaagaagtccaccaagtccagactgtgcttcttctacctgctgtactacctgtttttcctgaccgtgtgcggcttcacccctccaccacttattctgtggcctcaggcagcccctggcgagaagctgaagcactgttttaaagcctggggcgtcgaccctcctggcagcgtttggattctgccctgcttcctgattcacctgagaaaggtggacacccaccacctccaggtggtcaccaaaacagtgaccgccacaacagccgacggccagaggatgagaaggctgaagtgcaaggcctgccggctgagatgggctagacctgaacctgcagctcaggcccctcctaagagccactttccacctcatcctagcggcccctccagaaccagctctctgcaattgagaacctacatggaaatgcactacggccatcaggccccacaggtggcaatgctgcctaaactgctgtgtcggcagatgctccccactctgtctaccctgcagcagagacatcctcagggcccatgtcctcctccagtgacacctctgagagtgcagtctgtgctgctgctcggagtgcctcaaacagctggctacccctacgatgtccctgactatgcgtcctaaaggcgcgcctagcggccgc

SEQ ID NO: 1214 - DNA, 5299 bp, Artificial Sequence
  Cloning cassette hINV 4C
  Cloning cassette hINV 4C (1)..(5299)
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatggacagcaagaagatgacccagaagaaccgcaagacccggaaggccgccagagagaagcacagaaagaccgacaacctggacctgcagcaccagcgcagacgcaaaaagaagaaggacaaggtcgagatccggaatcggagccctaaggccaatagcaccgagtgtcagggcgagcacagcagagagcagaacctgctgaacctggtgcaattgaaccctcacagccctcaccaccggaaggacgaggaagatcaccagaagagacaccaccaccacaatcaaaagaagatgtccgtcaacgagggcaacaaccactggcctagagtggaaatgcctaccggctggctgctcgtgggctacaacaccagaaacacagcccagaatcctcggctgcagcagcacctgaaacactggcagcagtgcaccagagccagatggtgtcaagagccctgtcagaccctgaccttcttccacttcttcttctttttcaaaacggtgtccctgtgctgccccggctggtctaaaggacaacctcctccacctggcctgaagccttctagcctggcttctcaggtggccagaaccacaggcgtgtaccagcacgtgtggctgatctgcttcgtgtttttcgtgtgcgtggaaaccggcttctgtcacgtggcccaagtgggactcgagagactcgttagcctgagcggcatcaccgacgtgaaccattgggcccagcctaagccatctcctagcaaaggcaccggcatgaacagacccatcggcctgagagttggcaaaggcgtgtgggctagactgtggctgaagaactggaagcggttcaagctcaaaaagaaatacacaggcatggaaatcctgctgtggattctgctgaagatggaaattcagatcttcaagatttgcctgggcgagatgcagctgtgcctcaagaagaaagtcaacgcctgcagcaacgccaagaaaatgcccttccagtgccggtgcagacgcgagtacagagtgaccatgattcagaagaagaaacagaagtccccgctgttcttccacggcgacctgtgcagaccttctccttgcctgtcttggagcagcaggatcgtggctcctggacacgccctgagctgtcggactcgtagaagatggtccagcaagatggccaagaagtcccagcagcctctgtgtagaggcggcccttctgccagcgatagatgctgtagctgtagccccagcggctttagcgctggaagaggcagatgtcctgtgcagggatgtctgaggccacacagagttcagctgctgagaagatggggccctggatctcctgctggccagagactgtctaagggcttccaactgctgcgttggtggggaccaggatctccagctcctgagcctagaaagggcccatttccaccacctgatcctccatggcctgtgaccgctgtgacagtgatggctggctctgtgcctagcgctcagtctgtggatgctctggaatcccctggacctctggctctcgaaggccctagcagccctagaaacctgctctggcgggaaatgagcatcttcctgcctggcatcttcaacctgcacctgtgctactaccacagccagagcaaccggaacaagagccggcagatggaatccctgggcatgaagctgcagatcacacacccattcgccagccagccactgggccaagagatgcccaacaacacccagatcagactgctgaagcccggccaggcctttggcagcttttccgccgatttttcagcccctcagcaggcccctctgagactgtggtcttggtgcggcacaagccagacctacttcggctctatcgaagccctgacagccctgttcacctgtagaaccgccagcatcagcgtgaacatcagcaccctgatgagcatcctggaagccatcctggccatgacactgaccctgaatggcagccctctgtgggactgcagcacaacaacaggcacacaccacggctgcctgtgggagatcccttctgttaccctgctggctaccgccaaaaagagccctaccagcttctgctgtcagcggcctcctctgcagccagtggaagagaagaagaacggccggatcagcagcgtgccaccttctccacctcttgctctgggccctagaatgcagctctgcacccagctggcccggttcttccctattacacctcctgtgtggcacatcctgggacctcagagacacacccctctgctgacccctgacaccagatggatcttctccaaccagctgcagaccgtgcagatgctgtgtctgcctccactgaagcagggcgagagaatcatctggcctctcggcggctttcagatccccaacttcttttggagcctcggcatcggacacactggcgcctggtggcatactggaaggcggagaagagaatggggcggcagcaccgtgtctagaagcccactgtggatcagctccatgatctacctgagaggcatggccttcgcctccgacagcagcatcagaaccaccagagtgtcctggtgtcggagatgtggcgccaaaagcgccgcagccagcagcgacaagaagaagaaaagcaccgaaaagaccaagaacaagatcatctgcaagggccacagaatcacccaggtggtgctgagactgggcaacctgcctccattcttcagaggcagcgaggtgccctttcctagaccttgccggaccaagtgccagaagaaggttccaagcgcctctccttggggactgcacccaagaacagcctccatcacactgcctaccaccagcctgaagggcagcagaacaagctgctgccccagatctcaccccagactgcccagaacaaagtggcctctgcagtgcctgctgcacagcctgggaacaactggaacactcgtgtgggaaaggggcgtgctgcagatgagaagtctggaagctcactgccctctgcagacattccacctccaccactgcagaacccagcctagctcttgtcctccagcctggattctgtaccaaggacagtggagcggagccgtcgtgggacttagacctgtggctcaccatctgccaagacctatccaggggctgcactgtcctcaggctcctcatcaaccagctctgtcctggggaaagtggcccgtgggaatgacaggacccgccagatgttgccggtggcctagaagaatgtgtagctctctggccctgccaaccggcctgacatctctgatcctgcctagcagtgatctggccgtgctgatctctagctccaccagccactttctgatgcggagcccagtgctgccaagcagcagactgacatgtgcctctccacagctgcctcggatgtggacatggtctagctggctgaaagagtggggaggacaggcccacagacagcggaactgtagagtgaacgccgttgaggaactgcacagcaggcggatgtctgtgcggatcgtgaagaattgggtgtcctgctgttacgtgcggctgagtgcagtgggactgtctacttggagcgccctggattccctgatcctgtccttccagagagtgaaaaccagccggatactgaacctccaggtgctgaagaagatcctgcggagctttatgaagctgtaccactctctcgtgatgtgcctgcggctgcggaccaagctggaaaaagctctgagcgctctgtttatctggccccagcacagctacaaaggccaggcattcggaagcctgtgccagctggtgtctgccgatttcagcgcccctcaagtgaccagactgcggagcctgaaccatctgctgattcggtggatctttagcaatcagctgacagtccaaatgctctgcctgccgatcatcaagaaaatgaagaaacggatcatggtgcacgtcttgaagaagaatcggaagcagattatctgtatcaagaatatgttcctgcagcggaagggattcctgaacctgagccacgtggaaaagttcagagagagcaccctgggcaatttctggatgaagctcctgcagctgccaccagcttgcacctctaaggcctggacacccagaaagcttgtggggagagccgtgcggagaaagggcgtcgtgatcaacctgaagagactgcagaaattccgggctagcgtgtccttctggactctgctgcctacaacaggcgtgcggacaagaggctctccactgagactgactctgtggcctccaagaagccagaaaagccagcaccactgcgccctgagaaagatcgagtgggccacaaagctgtccctcggcggcaaagcaggaccacaggctcaagagaaggccaacatcctgaacagcctgccttcctctatggaaatcgccgtgctgcaagaaatgctgaaccagaagtgtctggcccctttcgagcttaagaagaacctcctgctgccaacctacacaccccacatctgtcggcacacccttaaaaagaagcccagagacatctgcagaatcagcggctacccctacgatgtccctgactatgcgtcctaaaggcgcgcctagcggccgc

SEQ ID NO: 1215 - DNA, 5299 bp, Artificial Sequence
  Cloning cassette hINV 1D
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatggccgacaagaaaaacgtgcggagcgctagttctcctggacatcctcttggccccagaagaatgaccagacggaccatgaccaccaccaaaatgatgatgatgcggcggaccaagcggcggagaagaaaaagacgccggatgaccatgatgaccagaagaaccctgctgaccaagaaaacctgtctgacccctagaaccagcgccgccacaaaagctctgcccagacagacaatcagccagcggaggcctatccagacacctcctggaacaagcctggccatctggggcagaagaagcaagatcgaggcctctcctatcggcagcatcacccctctgagcatcagcagacctaccagcagagccagacagagctgttgcctgcctggactgacacaccctgctcatcagcctctgggctctatggttggagctggaacaggcggaggacctgcttgtgtgcctgtggccgaagcttctacaggcgcttggacagctgaaggcgctgccggcacaagatgtagagccagcagagccccttgcagacagctgcctgcttctagccctaccaagtgcgagatctgcgtgaagagaagaaggcggcgcaagcggagcagccagtctagatctcccgtgcctaagaaacgcgagcggatgatgctccctgtgcgggccagaacagctagatctgctctgccacaaggcagggctcctctggaaggaatgcttctgcctagagcactgcccagcctgctgagcagaatgcctgccagaagagagagcagattctggctggccctgcaggcccttggactcagacctcctcatctgcctagctgtcaccctctgcctcaactgcttggacctcctccacctcatcaggcccctggcgagaaaaacgacctgcagctgttcgtgatgagcgacaccacctacaagatctactggaccgtgatcctgctgaacccctgcggcaacctgcacctgaaaaccaccagcctgaacgccaagaaaatggaagatatgatctgggagagcaaccagcagctgaagtggacccctcacatcctgaagtccgcctctatcgccaagaagcggatcaagctgcggcggaacagcaccagacgggaaatgccttctcaggccacaccttctccacctggaccttggagagccgctctgggcaaagaagtgaagcggagccagagcaagctgagactgagaaacacaagccccttcgacaaaaagggctttgtgatcctgagcaacatgggcggcaaccggtctatctgcctgaccatcgtgttctttctggccccttacttccccatgcctagcagctggtctagcagcggcagaaccagactgcctctgaggccacagagaggccctagacctctgcatagatggctgcagcagaccaccggctgctctcagagaagaggcgactgcccaagaaccatggccggaccatctgcttctctgcaccctgcatctggcagagcctccagaaagacctggcagagaaggctgagagcctgtagagcaggcggacctgctggatgggctagacaggccagaaaacgcaagagagagaagcggtcccagaagtccagacagaaccatctgcagctgaaaagctgcagacggaagatcagcaactggtctaagctgcggagcccctggatcttcgaggccaaaaagagcatgaagagatcccagcggcctcctcggagcatcctgagcctgttcaagaagaagaagcccctgacattcagccccagcgtgtccaagaagaggctgcctaagctgaagggcaagaaacgccggaaagaaatccagcggaaggtggtcaagaaccccagccagcctgtgccactgagaaatgacggcatcaccaacggcaacgacagcacccggtcttgcagcatcagcctgaagaaaagcctggaaaagatgcccctgatgcggagcctgctgtactccagaatgtgcctggtgcagatccccacacacacctgggagcccgactactttgtgtccctgcctatgatgttcagctgggccacacagagctttccagtgggcgccgtgtttctgaccagacctgccattccttgctgtagctgtaccagccactccaatccttggagccagtccacactggccatccggtttatctctgcccctcagccaagcagcagcaccgttacagctgctcctagcggccagtattttgccctgcggagtatgcccaagagccggaaccaggtgctgtttcggagaaatctgaccccaagccagctgcggacactggcccctccatatatgctgctgcctcagtctctgtcccagagcctgtctcggaagcagatcccatctcagtccatgctcgtgcggaccaggctgacactgacaggcactagaagctccggcaccagagcctctccatctgccgtgtgtctgtgctgctggacatgccccagcagaagctttcctgccgcctctccaagcggactgagagcacctgttggagcacaggctcctccagaagtgacactgagagccagctgtgccagctccgccagcaaagcttgtgcaggactttggccttggggagcccaagtgcggatgaagaagaaggacagcaccatcttcatctaccccaggctgaaaaccttcggcgtgccactgggcagcattctgtgtctggctggaagcctgagcacgatgatgatcattagcaccaccagacaagagtgcggcagacgggccagcgtgccctgtagacctatgatcggaagcgccagacctggaccatggcggacaagtgctatgccttctgccatgggagtcgccctgcctaccagctgtgaaagcggaagatctcctcctgccaccggcggaagaatgccaggatctcagtctatcatgatgagctggatgcctccactggctccctgcgctgcttgtccttgttctcctgctcctacactgtgccctgctcaccctgctagagcaccaacagccgtgcctgcctttacacccctgtctgctcatcctgtgccagtgctgtctggatgtcacctggctgtgcggacctccatgcttaccttgctgccaatgatgaccctgaaggccctggtcaagacatggacccagttcagaaactaccccagacggcaccctcacagaagcccaccaacaagctgtcctccactgctcgaggcctttccactgccaagagccagcctgagagctaccgtgcctagacactctagcgtgctggccacaggactgcatctgcataggcagattagcctgcctctgcggggcttcctgctgcatcaaccactgccaggacaacacctgtggctgtcccacagactgagactgcggctgcctagaacaaccgagatccagctgaccatgaacgactccaagcacaagctggaaagccccgctctgaaacaggtgtccccagctagtcctcctacacagcagcctcagacaccccaggattctagacaggtgctggccgtgcctatgagcctggcctgtagcatcaccgtgtccttcgtgggccagatctctaccctggtgctggacgtgtcctccatcagccactggaacggcatctgggaagtgatgcccagaacactggaaggctgcatctccgtgaaggaccaccggacatcccagaaccacagcaagtgcatcaccgagtgtgtgcggacagccctgaacaccaagtgtgaaatttgtgtgaagaacaccgccatcctggctatcaccctgatcaccccacaggaccctcacctggaccctgtgtgtcatccccatagaaggcccggctggaagggacaccacagagtggtgtttagccaccatccttccggcagcaccaagtctcactggcagcagagagaaagaggcggaggccgcagagaaaagaagggctgtagagaggcaagcagagccggccagtttcctgtgtggcggagaacatctagaggcatgtccctgcagtggaagtccggcaatgcctgcacacctctgagatgtcccagcagatctccagccaccttcctgactgccctgaacggctggcatagatctggactgagggcccagaccgccttctttctgctggacatcatcctgcggagagcccggcctacaagctgcagcacatgtagaatgtggtggcggctgccctgcaaagtgaccgaaagctccctggccaagaaaaccctgaccaatcagcctagcttgcccggaccttgtgctagcctgctgtctacactgagccagccaccacctcaggctcctagccaagtttggacagccgctacactgcggtgtcctgctgtgcctgctgctgcatgtccacctctgaagctggctccactgcaagtgaccacaacactgaagctgatcctggtcatgctggaaatcgtgaccgagaacaaagttcggcagaacttcaagcggaactccagcttcttctacaccagcgacagaggctacccctacgatgtccctgactatgcgtcctaaaggcgcgcctagcggccgc

SEQ ID NO: 1216 - DNA, 5281 bp, Artificial Sequence
  Cloning cassette hINV 2D
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgcggaagatgcagagcctgaatcaccccagcagactgaccaacaatcctcggagaaagacctggaagatgcggaagaagtacgcccagaagcctagccagaagaaccacctgtaccggcagatcaaccggcgcaagctgcagagaaagaagtccagaagccacctggacttcagcccctactggatgaagaaagtgaagcgggccagaaaccggaacatgaagaaaaccatgagccacctgatcgcccatcaggccctgaagatgtctggcctgagactgtttcaccccagactgctgaccagaaagaagcccggcaagcagaaaaagggccacatgatcttcagccggcggaagtggcagatccggcacgtgctgaagaatctgatccccagcctgaacgcccagtggatgttcctgagaatcgctagcccacagatcatgcagagaaccagcgccgaccggttccggatgaagcggagaatgcagaacctggacaatctgggcgtgccctggcctctgttgcctggattgctgctggcccatatgtacggcttcagcacctacggcacccagaaaggcgagtgcgtgtgtctgcagtgtctgagcggcagcagcctgttcatcctgaagcagcccctggacctgaagatctccaagaccttcatggccagccctcagattatgcagcggatgagcgccgtgaacttcgagacaatcctgcaggcccatcctcaggtgccagctcttgctcctcaagcttggtggcccgctagaagaggccctctgacatctgctccaagcgcacagcagtccctgacacggacactggaaagcgccggactgtttccttggctgcacacccagtgccgggccttcattcacacacctagaagccctggctgcagcgtgtacgccaacatgtgctggcggtacaagaaacggggagtgatcgcctggcggatctaccctcctagcacatgcagcctgccttgcagaggcctgatcctgattcagcacggcggcatcttcaccttccggttctgggtcgagaagctgagctggaacatctgcaagaacctgagcctgtacctggataagttcgtgcagcggctgctgtacgtgtacatcatcgagacaaacgtgttcgtgctgaacctgttccacgtgccagtgaaccagatcttcatgatggccttctacctgaagtacaccgagaaggcctgggtcatggaactggaatggctgatccagcagcagtgctaccagcggaagagaatgaagaccggcgccatccaagagaagggcgctattcaagagaaaggggccatgaccaagcggatctgcgtggtcaatttcgaggcctgcagagagatggaaagcctgagcgcccctgagaagatcaccctgtttgaagcccacatggcccggtgcaccagcatcaatgtgctgtgtgtcagggccagcctgatcgagaaactgatgaaagaaaagcgcaagatgaagcgcaaccaggtggcatcccctcaaatcatgcaacggctgttcatcaagggctaccagaacaaccacttcacgttccacctccaaaacttcgccttcttcagctccttcggcaacaacaagtatatcaacatcctgacctttctgcccagcagattcccttggggacctcctccactgggagcccttagagctacagctcctgctacagctgctccccaggcacagacacctcattggagagccgccaccacaagcagcatgagcagctctccaagagccgagcctaccagctctagctcttgggccacttgctggcctagatgctgcagctccagctgctattggagcctgtctagctggcctcctgctggcgctgccgaagccacaaataccagaaccagaagccgcgagagccagcggggaagaatgctgacttggagaagctccctgtggctgcagggcaccagatgttttacaggcgtgcggaccagctccaggtgcagcctgatggaacagatccctcacctgaagtctaacagccggaagaaactgctcgaggacatgaagcagaacggcttcaccagacggcggaacagcagaaagcagagccaagtgcagctggccatccaggtgctgctggtggacaagcacaagtactttctgttcggcagagccacatttctgctggctctgtgggagtgtagcctgcctcaggctagactgtgcctgatcgtgtctagaaccctgctgctcgtgcagtctagacacccaagctggccttggaccagatgcctgagaatgcggcctccacgcagccactggaactctgcctacctggggagaacactgctcgtgacctgcatcctgtaccacagatggatcgtgaccagcatgtgccagagccagagatggctgacctccaccacctctagaagctctgccctgatgtggacctggtggtgtacaagaggtggcggcaagcggaagaaaaagatgtgcaaggtgtccggcggctgcaccgcctgtgttgaaagatgtccttggaagggcatctgttggaagtggcctgtgacagtggccgccatgagcagaacacctccaagacgcgtgtgcggccacagagagggcagcgagtctgataatctgggcctgctgtactcctttccacctgtgctgttcaaggccgaccagagcgaaagctctctgagcagcggcaacagcgtgatcgtgcacaagatcgtgctggtgttcctgaagtccctgagcagctacaactgcgagagaagaatcagcggcatccagaagagagccatcgagttcgccgtcctgaagctgctgaacatggacctcggcaagggactgacacaccccgtgcctctgaagaggaccctgcagaacaagcggaacaagaacatcaagcgggtcaaccagaagaagggcaacatcaagaggaagtccatcctgctgcatctgattgtgctgaacagccccgagagcaaccgggaaaagatcatcaaccccaccatcagctgcccctttcagagccccacaaagagactgggaagccctcctctgcacctgtgtcagcctctgaggccctatcctatcagcgagggcctgaccatgaccaccggcagaaacatcaacagcaactccctgatgaccaactgcctgttcagccccatcttcctgtgccaccacgccatcatgcaccggaagatgacaagccctcacttcagactgttctccagcaagatcccacatccacaggtcccaagtgtggtggccctgtgcaagtttacacacccctgcaccatgctgctgccccaaggcgctttttggaagcctcctagccagggcatctccagctgtctgatgacaggctgttggcagtggtccagcgtgacaagcctggaatggacagcccaagagagaggctgttcctcctggctgatgaagcaaacatggatgaagtcttggtccctgcgggaccccagctacagatccatcctggaatacgtgtccacacgggtgctgtggatgcccacctctaccgtgcctaagttctttctgaccttcagccagatccggatgtgcgccctgtctcaccctagcttctacatcagctccaccgtgtgctttctgagcaagcactgcatgaccgcctgcacacctggaaccagcctgcagtgttacctgaacctggccaacggcctgtggttcaacctgatcttccggaacaaaaagaccaagctgtggttctccctgattaacatccaccaccgcaagaacccactgctgcccatgcggctggaaaaaaaggccacttggatgcggcggaccgagctgtctctggaaccttggattccttacctgcatcagcagaaaacccagtggctccccatgagaagcctgggcgagccttggcgagctggatttcagtggggagagtctccctggcaagtgatggcctctctgacaggcagacgcaagaaaagagaggatcactgcggactgcaagagaaaaaaagccggaagctgatgtccagctgcgccgctcctccacatagactgctgggacctagcagatggggaagctgtgggagagcctgttcttgtggcagaggctgtggaacccctagaggcgactggaagagacacccacctcggcggattctgtttcacgtgcggaacatcgtgtacggaatccaagtgatgctgtgctgtcaccccgcctggctgtctccaatcagcgcttgtcctcgcctgctgccttatccattccacgttctggccctggaagtgacattccctccaggcactgccatgcctcagatgcaattgcaggcactggcaatgtgggagaaaggctgggacaagcctctggaaaacacacagatccccaggacaagcccactgtggaagatcacaatggtgctgacataccccaactgcgtggtgcacgtcctgatgttcggcggcaagaagcggagcaagttcggctacccctacgatgtccctgactatgcgtcctaaaggcgcgcctagcggccgc

SEQ ID NO: 1217 - DNA, 5296 bp, Artificial Sequence
  Cloning cassette hINV 3D
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgcagaacaccagaagcaccaacctggaaaagaaccccagcctgaagaagcagagccagcggagaggaaagctgagcagcagaaagaagggccacaccaagaaccggcggaaggccaagagaaagccccagatcagccagaagaaggaccctgccggcaagctgaagaaacacctgaaccggaagctgcacctgaccagatcctgcctgatcgacctgaccatgatgatgagccagaagctgtggaagaaccagcgcaagagaatccctctgccttctccacggcagcatctgctgcctcagtatccactgcatcctccacctccatgcctgctgctgctccaccacagacaccatctggcctttctcgagatggcctgcagcagccagcacacccacagcatcaagatctggatcagcttcagccacgaggacctgcctagaatgctgcccatcagcagccctctgcacagaccccagatgcctttctggacctgcacctttcctgccaccacatggggcacatgggagacaccttctacatggggctggcggacattcggccctgtgtactacgtgtgcaaccggatgaacgtgtccagcgtgctgaagcctttcctgttcaccgtgcctatcgaggacatgagagagtgcaccctgggcagaaacagaatgaatgtgtcctctgtgctgaaaccctgtctgatccccgtgccaatcctgaccacactgagcttcgtgctgatcgaggaaagccggcggaacagacggtacagaaagatctacggggagctgaagatgtccctgcaggccctgcctctgacctttagcacactgctgtgggacagcagacacaccaccaccacaagcagccccagaagatcccctgctctgagagctagaggcggcaccacaatcggcgaagtgacaagcagaggcgccagcagctctaccagcagagacagcagaagctttttcaccagcgctcaccccagcagaccctgcagaatgagactgtaccagagcaacggcatggaagcctgcggcacacaccctacacctagactgtctagaggccctccactgcacaccagaaccatgagcctgagcaacatcctgatgaagttccggctgatgctgcagaagcagtgctgctacaacctcgtgatcaagcaccctctgatcttccggatcaacctgcggagacagggcaagaccaaagacggcgttgtgcagagcctgggcttcctgaaccagcagatcatcctgcagaaagagttcttcatctgcctgctgatgttcatcaagcggtggaagccagccgccacaaagacacctccaccactgattctgtggcctcaggccgctcctgtgcacaagaagagaggcctgttcagcctgttcttctcccactgcctgtgccaccagatgaagtgcctgaccgccgtggattgtctgcaggccttctgggacatgatgattcgcaagatccagaagcggcggagaaccgccaaccggctgaaaaagaaatacctggtgcagtgtaccaacctgagcgtgcccatgatgctgaccatcctgatctggaagcgggtgttcatcctcctgctgagcgacaagaagtgtctgagagtcagatgcggcggatggctgtgtggctggacacctagaggcaagaacaagaagcggagaaagctgcggcccaagcacctgaagaaaaccagcgccaaggtgtccgtgatcaccatgaagctctgggagaagcacttcaagggcctgaactggaacctggtcgtgtggattctgaacctgaagatgatgtggctcaagaagtccaccaagagcagacagagcagcccattcctggctcggagctggaataccatgcaatggaacaacaagaaaatggccatgaccgtgatcgctggcgcccaccactgtcagtacaagctgacctacaccaaagtgtggaagatgaattggaagaaaatgatgatcggctcccagcacctcctgtttagcccactggattcaagcccactgcagttgctgctgcaccctcacggcaagagatgcaacccttgctgcagactgacctggatgagcagagagtgggaaaagcggaagcagatcctcggcggaggcggcaagtacaaagagtacttcctgaagcggattctcatccggaaggctatgacagtgctggccggcgataagaaaggcctgggaagattcatgagatgcgtgcagagcgagacaaaggccgtgtctctgcagctgcctctcggccgaagaaagtccggcgtgatgaagtgttgggatctgtgccccagactggactttcaccccagatctagctctggcggcgagaagctgaagcactgtttcaaagcctggggcctgtgcttcttctacctgctgtacttcgagaagaaacggcccgagtggctgagcgttgaccctcctggatctgtctggattctgccctgcatggacctggacggaatgctgacagtgatcggccagggactcgtgggcatgacccctagagatctgggaacagtggctggcgccaccgcacagattcagaggcctatccaggtgcagacaggcggcagactgttcctgattcacctgagaaaggtggacacccaccatctgcaggtcgtgaccaagaccgtgacagccacaacagctgacggccagaggatgcggagactgaagtgcaaggcctgtcggctgagatgggccagacctgaacctgctgcacaggctcctccaaagagccactttccacctcatcctagcggcccctccagaacctctagcctgcagctcagacccattcctccacacctgagacacccactgctgctgaagggaaagaacagcccctgctgccaaaagaaactgcgggtgcagaaccagggccatctgctgatgatcctgctgcataacgccagacagcccagcaggcctaccggaagaacccctaccacaagactgatggcccctgtgggcagcgtgatgtcttgtagcctgctgacccagccatctcctgccagcgcatgtacaatgccaccactcctgcatccacagtgggccccacatagtgctggactgtctccaggcgcttgcagacctgcctgtacctgcatcagcatgaccaccatctccagagccacatggcggctgagaatcccaagcctgaggaagtaccggcagaacatcgagatcacccctcagcggtctaaggcccaggtttccgtgtacagcggcaatctgctgagcttctccagacggggcatgaagagtagcgtgcggctgaagaacagcatccctcacgtgccaaaagccaccgccgctcactctgtgacagtgaagctgcagtacctgtttttcctgaccgtgtgcggcttcgaccgggtgttcctggttaagatctgcaagaagaagctgctcctcaagctgctgagaggccccagacggaaagtgctgatggtgctttggctgcccgccaaccagagtctgcagaaaagccaggtgttccagtgggtgctgcggaccgaaacctacatggaaatgcactacggccatcaggcccctcaggtggccatgctgcctaaactgctgtgtagacagatgctccccactctgtccacactccagcagaggcatcctcagggaccttgtcctcctcctgtgacacctctgagagtgcagtctgtgctgctcctgggagtgcctcagacagccgcttttagcggccggattctgcaccagccagaaatggccgccatgagactgatgcccaagttcctgaactccaccaacagctggtggacagtggcccctagatgtcctagaagcgccgtggacattagccccggacctacatctcctagcctggcctcttgtgcctctgtggccattggaaaactggcactgctgggcgcatctgccccttgtggcgcagctggtgctagagaggctggaagatttgccgtgctgggcaccatggttatgaagggtgctgccgcagcctcctgtcagtctcctccatctccaagagagacaacccctagcagcgacgccaccagacggacaagacctattgccgctcagagcaaaaagaccatgactgccgccggactgacccctcggagaaacctgcagagaaatctgaaggtcctgggcgccaagaagatcaccttcctgagaaacagcagacgcgccacacctacctctaagggcagcctgagaagaaagtacctgagagtgaacatccgcaagctcatctggaccaagcagcggagcttcctgtctctgttccccaagctgagagccaccgagcagatgaccaatgtgggatgcctgctcaagaaaagcagccaattgcggcggagctggcgcaatgtgtcccggatcagcaacatggaacacaggctgaccatggacagcgccctgagcctgacaaagagagagggccctgagacaagcgagaagaagaggaagttgcctggctacccctacgatgtccctgactatgcgtcctaaaggcgcgcctagcggccgc

SEQ ID NO: 1218 - DNA, 5299 bp, Artificial Sequence
  Cloning cassette hINV 4D
gaattcggatcccgcgacttcgccgccatgcatcgacggcgctcacggagttgccgggaagaccaaaagcctgtgatggacgatcagcgggaccttatttctaacaatgaacaacttccgatgcttggtaggcggcctggagcaccagagtccaagtgttctaggggcgccctgtacactggtttctccatcctcgtgacactgttgctggcgggacaggcaacaactgcgtatttcttgtatcagcagcaaggaagactggataagcttacagttacatcccagaatctccaacttgaaaacctcagaatgaagcttccgaagcccccaaagcccgtctccaaaatgaggatggcgacaccgctccttatgcaagcccttcccatgggggctctgccccaagggccaatgcagaacgctacaaagtatggaaatatgacagaggatcatgtcatgcatttgcttcaaaacgctgatccccttaaagtttaccctcctctgaaggggagctttccagaaaatcttcgacatctcaagaacacgatggaaacgattgactggaaggtgtttgagagctggatgcaccattggctcctgttcgagatgtcccggcattctctggagcaaaagccgacggacgcacctcccaaggaaagcctggaattggaggacccgagtagtgggctgggcgtcacaaagcaagacctgggacccgtgccgatgaacagaaagaccagaaaggccgccagagagaagcaccgcaagaccgacgacaagaagaagaagtccaccgaaaagaccaagaacgccaagaagatgcccttccagcagcggcctcctctgcagcctgttaacctggatctgcagcaccagcgcagacgcaaaaagaagaaagacaaggtcgaaatccggaatcggagccctaaggccaatagcaccgagtgtcagggcgagcacagcagagagcagaacctgctgaatctggtgcagctgaaccctcacagccctcaccacagaaaggacgaagaggaccaccagaagcggcaccaccaccacaatcaaaagaaaatgagcgtgcgggctagcgtgtccttctggacacttttgccaacaaccggcgtgcggacaagaggctctccactgagactgacactgtggcctccacgggttccaccttctccacctcttgctctgggccccagaatgcagctgtgtacccagctcgcccggttcttccctatcacacctcctgtgtggcacatcctgggacctcagagacacacacctcaggctcctctgaggctgtggtcttggtgcggcacaagccagacctacttcggcagcagaccatctccttgcctgagctggtccagcagaattgtggcccctggacacgccctgagctgtcggactagaagaagatggtctagcaagcggtggatcttctccaaccagctgaccgtgcagatgctgtgcctgccaatcacacacccattcgcctctcagcctctgggacaagagatgcccaacaacacccagatccggctgctgaagccctgcagagtgaacgccgtggaagaactgcacagcaggcggatgtctgtgcggatcgtgaagaactgggtgtcctgctgttacgtgcggctgtctgctgtgggcctgtctacttggagtgccctggacgaggaaaagaagaacggccggatcagcagcctgaaaaagaaagtgaatgcctgcagctccctgatcctgagcttccagcgcgtgaaaaccggcatggaaatcctgctgtggattctgctgaagatggaaattcagatcttcaagatttgcctgggcgagatgcagctctgcggccaggcctttggaagctttagcgccgatttcagcgcccctcagatcattaagaagatgaagaaacggatcatggtgcacgagctgaagaagaatctgctgctgcctatgtgctccagcctggctctgccaacaggcctgacatctctgatcctgcctagcagcgatctggccgtgctgatctctagctccaccagccactttctgatgcggagccctgtgctgccaagcagcagactgacttgtgcctctccacagctgccccggatgtggacttggtctagctggctgaagaacgagggcaacaaccactggcctagagtggaaatgcctaccggctggctgctcgtcggctacaacaccagaaacacagcccagaatcctcggctgcagcagcacctgaaacactggcagcagtgcaccagagccagatggtgtcaagagccctgtcagaccctgaccttcttccatttcttcttctttttcaaaacggtgtccctgtgttgccccggctggtctaaaggacaacctcctccacctggcctgaagccttctagcctggcttctcaggtggccagaaccacaggcgtgtaccagcacgtgtggctgatctgtttcgtgtttttcgtgtgtgtggaaaccggcttctgtcacgtggcccaagtgggactcgagagactggtgtctctgtccggcatcaccgacgtgaaccattgggcccagcctaagccatctcctagcaaaggcaccggcatgaacagacccatcggcctgagagttggcaaaggcgtgtgggccagactgatcctggccatgacactgaccctgaacggcatggccaagaagtcccagcagcctctgcaggtcgtgctgagactgggaaacctgcctccattcttcagaggcagcgaggtgccctttcctagaccttgtcggaccaagcctgcctgcacaagcaaggcctggactcccagaaaactcgtggggagagccgtgcggagaaagggatctccactctgggattgctccaccacaacaggcacacaccacggatgcctgtgggagatcccatctgtgaccctgctggcccatcctagaaccgcctctatcaccctgcctaccacaagcctgaagggctccagaaccagctgctgccctagatctcaccccagactgcctaggaccaaatggcccctgcagtgtctgctgcacagcctgggaacaaccggaacactcgtttgggaaaggggcgtcctgcagatgagatccctcgaagcccattgtccactgcagaccttccatctgcaccactgcaggacccagcctagctcttgtcctcctgcctggattctgtaccaaggacagtggagcggagccgtcgtgggacttagacctgtggctcaccatctgcctagacctatccagggcctgcactgtccacaggcacctcatcaacctgctctgagctggggaaaatggcccgtgggaatgacaggccctgccagatgttgcagatggcccagacggtgccagaagaaggttccatcagcctctccatggggcctcgtgctcaaaaagaaccggaaacagatgctgaaccagaagtgtctggccccttttagagagagcaccctgggcaatttctggatgaagctgctccagctgcctgtcgtgatcaacctgaagagactgcagaagttcaacctgcacctgtgctactaccacagccagagcaacagaaacaagagccgccagatggaatccctgggcatgaagttgcagtcccagaaatcccagcaccactgtgccctgcggaagatcgagtgggccacaaagttgtctctcggcggaaaagccggaccacaggctcaagagaaggccacctctcggattctgaacctgcaagtgctcaagaagatcctgcggagctttatgaagctgtaccactctctggtcatgtgcctgcggctgaggaccaagctggaaaaggctctgagcgccctgttcatctggccccagcacagctacaagcccctgttctttcacggcgacctgtgcgagtggggaggccaggctcatagacagcggaactggctgaaaaactggaagcggttcaagcttaaaaagaagtacatccagaagaagaagcagaagtctaacaagatcatctgcaagggccaccgcatcaccatcatctgtatcaagaatatgttcctgcagcgcaagggcttcctgaacctgagccacgtggaaaagttctgtagaggcggccctagcgccagcgatagatgctgttcttgtagccccagcggcttcagtgccggcagaggaagatgtcctgttcagggctgtctgaggccccacagagttcaactgctgagaagatggggccctggctctcctgctggacagaggctgtctaagggctttcagctgctccgttggtggggaccaggatctcctgctcctgagcctagaaagggcccatttccaccacctgatcctccatggcctgtgaccgctgtgacagtgatggctggatctgtgcctagtgctcagtctgtggacgccctggaatctcctggacctctggctctcgaaggacctagcagccctagaaacctgctttggagagagatgagcatctttctgcccggcatcttcaccgccaagaaaagccccaccagcttttgctgcaatatcctgaacagcctgccaagctctatggaaatcgccgtgctgcaagaggacagcaaaaagatgacccagaagggccaagccttcggctccctgtgtcagcttgtgtccgctgacttctctgcccctcaagtgacccggctgcggagcctgaatcatctgctgatcacctacacaccccacatctgcagacacaccctgctgacccctgacaccagatggatctttagcaatcagctgcagacagtccagatgctctgtctgcctccactgaagcagggcgagagaatcatttggcccctcggcggctttcagatccccaacttcttttggagcctcggcatcggacacactggcgcctggtggcatactggaaggcggagaagagaatggggcggcagcaccgtgtctagaagccctctgtggatcagctccatgatctacctgagaggcatggccttcgccagcgacagcagcatcagaaccaccagagtgtcctggtgcagaagatgcggcgccaaaagcgctgccgccagctctattgaagctctgaccgctctgtttacctgccggaccgccagcatcagcgtgaacatcagcaccctgatgtccatcctggaagcacttaagaagaaacccagagacatctgccgcatcagctgccggtgtagacgcgagtacagagtgactatgggctacccctacgatgtccctgactatgcgtcctaaaggcgcgcctagcggccgc

SEQ ID NO: 1219 - DNA, 37184 bp, Great Ape Adenovirus
catcatcaataatataccttattttggattgaggccaatatgataatgaggtgggcggggcgaggcggggcgggtgacgtaggacgcgcgagtagggttgggaggtgtggcggaagtgtggcatttgcaagtgggaggagctgacatgcaatcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcgccgtcatctgacgcggagggtatttaaacccgctgcgctcctaaagaggccactcttgagtgccagcgagaagagttttctcctccgctccgtttcggcgatcgaaaaatgagacatttagcctgcactccgggtcttttgtccggccgggcggcgtccgagcttttggacgctttgctcaatgaggttctgagcgatgattttccgtctactacccactttagcccacctactcttcacgaactgtacgatctggatgtactggtggatgtgaacgatcccaacgaggaggcggtttctacgttttttcccgagtctgcgcttttggctgcccaggagggatttgacctacacactccgccgctgcctattttagagtctccgctgccggagcccagtggtataccttatatgcctgaactgcttcccgaagtggtagacctgacctgccacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatctacagtaagtttttttgtgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcaggccaaggaaattaccttccattttgtgcaagcctaagacacctgtgaggaccagcgaggcggacagcactgactctggcacttctacctctcctcctgaaattcacccagtggttcctctgggtatacatagacctgttgctgttagagtttgcgggcgacgccctgcagtagagtgcattgaggacttgcttaacgatcccgagggacctttggacttgagcattaaacgccctaggcaataaaccccacctaagtaataaaccccacctaagtaataaactttaccgcccttggttattgagatgacgcccaatgtttgcttttgaatgacttcatgtgtataataaaagtgagtgtggtcataggtctcttgtttgtctgggcggggtttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtcttcagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgcagcggcaggggctgatgtttcccgaccatcgccagcatcagaatctggaagacgagcgagcggagaagatcagcttgagagccggcctggaccctcctcaggaggaatgaatctcccgcaggtggttgagctgtttcccgaactgagacgggtcctgactatcagggaggatggtcagtttgtgaagaagctgaagagggatcggggtgagggagatgatgaggcggctagcaatttagcttttagtctgataactcgccaccgaccggaatgtattacctatcagcagattaaggagagttgtgccaacgagctggatcttttgggtcagaagtatagcatagaacagcttaccacttactggcttcagcccggggatgattgggaagaggcgattagggtgtatgcaaaggtggccctgcggcccgattgcaagtataagattactaagttggttaatattagaaactgctgctatatttctggaaacggggccgaagtggagatagatactgaggacagggtggctattaggtgttgcatgataaacatgtggcccgggatactggggatggatggggtgatatttatgaatgtgaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcgccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaactttagccacactaaaatcctgctggaacccgagtgcatgactaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagtccctatctgacagtgcgcatgcctcactgggccggagtgcgtcagaatgtgatgggttccaacgtggatggacgtcccgttctgccttcaaattcgtctactatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtttccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattttttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgcttagctgggaggggtgcatccggggggatatgatgtgcatcttggactggatttttaggttggctatgttcccgcccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctggcatcgctcacatcgtagttatgttccagggtgaggtcatcataggacatctttacgaatcgggggcgaagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttctccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcactggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggttgcccccatgctttttgatgcgtttcttaccttggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccaacgggggggtataaaagggggtgggtgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttatcaagcttggtggcgaatgacccgtagagggcgttggagagcagcttggcgatggagcgcagggtctggtttttgtcgcggtcggctcgctccttggccgcgatgttgagttgcacgtactcgcgggccacgcacttccactcggggaacacggtggtgcgctcgtctgggatcaggcgcaccctccagccgcggttgtgcagggtgaccatgtcgacgctggtggcgacctcaccgcgcagacgctcgttggtccagcagaggcggccgcccttgcgcgagcagaaggggggtagggggtccagctggtcctcgtttggggggtccgcgtcgatggtaaagaccccggggagcaggcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggataccgaggtaggtggggtagcagcgccccccgcggatgctggcgcgcacgtagtcatagagctcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcgcggatgatgtcatacctatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtgtcccacgatgtagagctccaggaagcggggctggcccttgatggaggggagctttttaagttcctcgtaggtaagctcctcgggcgattccaggccgtgctcctccagggcccagtcttgcaagtgagggttggccgccaggaaggatcgccagaggtcgcgggccatgagggtctgcaggcggtcgcggaaggttctgaactgccgccccacggccattttttcgggggtgatgcagtagaaggtgagggggtctttctcccaggggtcccatctgagctctcgggcgaggtcgcgcgcggcagcgaccagagcctcgtcgccccccagtttcatgaccagcatgaagggcacgagttgcttgccaaaggctcccatccaagtgtaggtttctacatcgtaggtgacaaagaggcgctccgtgcgaggatgagagccgattgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttttactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggttcacctcgcagagacgggtcaaggcgcggacagtgttgagatggtatctgatttcaaggggcatgttggaggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatttctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatttcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtaatcttgcatgagtctttccaccggcacttcttctccttcctcttcttcatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcacccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgcctgcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcagccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcctctccccgccccggtcaccacggccgcggcggccgtgtccggtgcggggggcgcgctggagtcagatgagccaccgcggcggcgacctaggcagtatctggacttggaagagggcgagggactggcgcggctgggggcgagctctccagagcgccacccgcgggtgcagttgaaaagggacgcgcgtgaggcgtacctgccgcggcaaaacctgtttcgcgaccgcgggggcgaggagcccgaggagatgcgggactgcaggttccaagcggggcgcgagctgcgccgcggcttggacagacagcgcctgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgctcgcaagatctacaagaccccctacgtgcccatagacaaggaggtgaagatagacagcttctacatgcgcatggcgctgaaggtgctaaccctgagcgacgacctgggagtgtaccgcaacgagcgcatccacaaggccgtgagcgccagccggcggcgcgagctgagcgaccgcgaactgatgcacagtctgcagcgcgcgctgaccggcgcgggcgagggcgacagggaggtcgagtcctactttgacatgggggccgacctgcactggcagccgagccgccgcgccctggaagcggcgggggcgtacggcggccccctggcggccgatgacgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcagacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggcaacctgggctcgctggtggcgctaaacgccttccttagcacccagccggccaacgtaccgcgggggcaggaggactacaccaacttcttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggacttcgaggtgcctgaggtcaacgatgggttcctctgggatgacatggatgacagtgtgttctcccccaacccgctgcgcgccgcgtctctgcgattgaaggagggctctgacagggaaggaccaaggagtctggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctgcagcccgtgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctagacagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagagaaaaataaaaactcaccaaggccatggcgacgagcgttggttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggagagcgatatcggggtcaagtttgacaccagaaacttccgtctgggctgggaccctgtgaccgggctggtcatgccgggggtctacaccaacgaggcctttcatcccgatatagtgctcctgcccggctgtggggtggacttcacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggcggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcattgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtacactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatccacccacacgctccaaaatcatgtccgtactcatctcgcccagcaacaacaccggctgggggctgcgcgcacccagcaagatgtttggaggggcaaggaagcgctccgaccagcaccccgtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtgagcggcacacgtgtgcccgtgcgctttcgccccccacggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggaggattacaagccccgcaagctaaagcgggtcaaaaagaaaaagaaagatgatgacgttgacgaggcggtggagtttgtccgccgcatggcgcccaggcgccctgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgatttggggagtttgcatatgggaaacggcctcgcgagagtctaaaagaggacctgctggcgctaccgctggacgagggcaatcccaccccgagtctgaagccggtgaccctgcaacaggtgctgcctttgagcgcgcccagcgagcagaagcgagggttaaagcgcgagggcggggacctggcacccaccgtgcagttgatggtgcccaagcggcagaagctggaggacgtgctggagaaaatgaaagtagagcccgggatccagcccgagatcaaggtccgccctatcaagcaggtggcgcccggcgtgggagtccagaccgtggacgttaggattcccacggaggagatggaaacccaaaccgccactccctcttcggcagcaagcgccaccaccggcgccgcttcggtagaggtgcagacggacccctggctacccgccgccactatcgccgtcgccgccgccccccgttcgcgcggacgcaagagaaattatccagcggccagcgcgcttatgccccagtatgcgctgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgccttcgcttcccggtgccgggataccgaggaagaactcaccgccgcaggggcatggcgggcagcggtctccgcggcggccgtcgccatcgccggcgcgcaaagagcaggcgcatgcgcggcggtgtgttgcccctgctggtcccgctactcgccgcggcgatcggcgccgtgcccgggatcgcctccgtggccctgcaggcgtcccagaaacattgactcttgcaaccttgcaagcttgcatttttggaggaaaaaataaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggtcagatgctgagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtctcccgagggcaaaggcgaaaagcgcccgcggcccgacagggaagagaccctggtgtcacacaccgaggagccgccctcttacgaggaggcagtcaaggccggcctgcccaccactcgccccatagctcccatggccaccggtgtggtgggtcacaggcaacacacccccgcaacactagatctgcccccgccgtccgagccgactcgccagccaaaggcggtgacggtgtccgctccctccacttccgccgccaacagagtgcctctgcgccgcgctgcgagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcttactcttacaaggcgcggttcacgctggccgtgggcgacaaccgcgtgctggacatggcctccacttactttgacatccggggggtgctggacaggggccccacttttaagccctactcgggcactgcctacaaccccctggcccccaagggcgcccccaattcttgtgagtgggaacaagaggaaaatcaggtggtcgctgcagatgatgaacttgaagatgaagaagcgcaagcacaagaggaagcccctgtgaaaaaaattcatgtatatgctcaggcgcctctttctggcgaaaagatttccaaggatggtatccaaataggtactgaagtcgtaggagatacatctaaggacacttttgcagataaaacattccaacccgaacctcagataggcgagtctcagtggaacgaggctgatgccacagcagcaggaggtagagttttgaaaaagactacccctatgagaccttgctatggatcctatgccaggcctaccaatgccaacgggggtcaaggaattatggttgccaatgaacaaggagtgttggagtctaaagtagaaatgcaatttttctctaacaccacaacccttaatgcgcgggatggaaccggcaatcccgaaccaaaggtggtgttgtacagcgaagatgtccacttggaatctcccgatactcatctgtcttacaagcccaaaaaggatgatgttaatgccaaaatcatgttgggtcagcaagccatgcccaacagacccaacctcattggatttagagataatttcattgggcttatgttttacaacagcaccggtaacatgggagtgctggcgggtcaggcctctcagttgaatgctgtggtggacttgcaggatagaaacacagaactgtcatatcagcttctgcttgattcaattggggatagaaccagatacttctccatgtggaaccaggcagtggatagctatgatccagatgtcagaattattgaaaaccatgggactgaggatgaactgcccaactactgcttccctttgggcggcataggagttactgatacttatcaagggataaaaaataccaatggcaatggtcagtggaccaaagatgatcagttcgcggaccgcaacgaaataggggtgggaaacaacttcgccatggagatcaacatccaggccaacctttggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgccgcctgcatgacgggttccaccgagcaagagctcagggccattgccagagacctgggatgcggaccctattttttgggcacctatgacaaacgcttcccgggctttatctcccgagacaagctcgcctgcgccattgtcaacacggccgcgcgcgagaccgggggcgtgcactggctggcctttggctgggacccgcgctccaaaacttgctacctctttgacccctttggcttctccgatcagcgcctcaggcagatttatgagtttgagtacgaggggctgctgcgccgcagcgcgctcgcctcctcgcccgaccgctgcatcacccttgagaagtccaccgaaaccgtgcaggggccccactcggccgcctgcggtctcttctgttgcatgtttttgcacgcctttgtgcactggcctcagagtcccatggattgcaaccccaccatgaacttgctaaagggagtgcccaacgccatgctccagagcccccaggtccagcccaccctgcgccgcaaccaggaacagctttaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttaattatacacgggctctttctggttatttattcaacaccgccgtcgccatttagaaatcgaaagggttctgccgtgcgtcgccgtgcgccacgggcagagacacgttgcgatactggaagcggctcgcccacttgaactcgggcaccaccatgcggggcagtggttcctcggggaagttctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactggttcgcgggacagctggcatcgtgcaggcagcagcgcgcgtcagtgttggcaatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatggtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctcagagaccgccgatgcgcccgccgtcgccgtcgcccccgctaccgccgacgcgcccgccacaccgagcgacacccccacggacccccccgccgacgcacccctgttcgaggaagcggccgtggagcaggacccgggctttgtctcggcagaggaggatttgcaagaggaggagaataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtgccaaagatcttcgagggtctggggcgcaacgagaagcgggcagcaaactctctgcaacaggaaaacagcgaaaatgagagtcacactggagcgctggtggagctggagggcgacaacgcccgcctggcggtgctcaagcgcagcatcgaggtcacccactttgcctaccccgcgctcaacctgccccccaaagtcatgaacgcggtcatggacgggctgatcatgcgccgcggccggcccctcgctccagatgcaaacttgcatgaggagaccgaggacggtcagcccgtggtcagcgacgagcagctgacgcgctggctggagagcgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgaaaaccgccttgggcagagcgtgctacactccaccctgcgcggggaggcgcgccgcgactacgtgcgcgactgcgtttacctcttcctctgctacacctggcagacggccatgggggtctggcagcagtgcctggaggagcgcaacctcaaggagctggagaagcttctgcagcgcgcgctcaaagacctctggacgggcttcaacgagcgctcggtggccgccgcgctagccgacctcatcttccccgagcgcctgctcaaaaccctccagcaggggctgcccgacttcaccagccaaagcatgttgcaaaattttaggaactttatcctggagcgttctggcatcctacccgccacctgctgcgccctgcccagcgactttgtccccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgaaatcaggttttacgaggaccaatcccgcccgcccaaggcggagctgaccgcctgcgtcatcacccagggcgagatcctaggccaattgcaagccatccaaaaagcccgccaagagtttttgctgaagaggggtcggggggtgtatctggacccccagtcgggtgaggagctcaacccggttcccccgctgccaccgccgcgggaccttgcttcccaggataagcatcgccatggctcccagaaagaagcagcagcggccgccgctgccgccgccccacatgctggaggaagaggaggaatactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccagcggcggcggcgcccgtttcggtgcctaggaagacccagggcaagacttcagccaagaaactcgcggcgaccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtgaagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagtttatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcgcacggggtgcgctttttcatcccgagtcaggtccgctctaccctaatcagggagttcaccgcccgtcccctactggcggagttggaaaaggggccttctatcctaaccattgcctgcatttgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgtggtctgcaccggcgcctgaggaaatacctagcttggtactacaacagcactccctttgtggtttacaacagctttgaccaggacggggtctcactgagggataacctctcgaacctgagctactccatcaggaagaacaacaccctcgagctacttcctccttacctgcccgggacttaccagtgtgtcaccggcccctgcacccacacccacctgttgatcgtaaacgactctcttccgagaacagacctcaataactcctctccgcagttccccagaacaggaggtgagctcaggaaaccccgggtaaagaagggtggacaagagttaacacttgtggggtttctggtatatgtgacgctggtggtggctcttttgattaaggcttttccttccatgtctgaactatccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccaccgcaggtagaataatgctgcttaccctctttgtcctggcgctggctgccagctgccaagccttttccgaggctgacttcatagagccccagtgcaatatcacttataaatctgaacgtgccatctgtactattctaatcaaatgtgttactcaacacgataaggtgactgttaaatacaaagatcaattaaaaaaagacgcactttacagcagctggcaaccaggagatgatcaaaaatacaatgtaaccgtcttccagggcaaactctccaaaacttacaattacaatttcccatttgagcagatgtgtgactttgtcatgtacatggaaaagcagtacaagctgtggcctccaactccccagggctgtgtggaaaatccaggctctttctgtatgatctctctctgtgtaactgtgctggcactaatactcacgcttctgtatctcagatttaaatcaaggcaaagcttcattgatgaaaagaaaatgccataatcgctcaacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtttcttactgcactaacaaaaacagccacaagcccagagccatctgcgatgggcaaaatctaaccttgattgatgttcaattgctggatgcgggctactattatgggcagctgggtacaatgattaattactggagaccccacagagattacatgcttcacgtagtaaagggtcccattagcagcccaaccaccacctctaccacacccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgcccaggatttggaagatcacgaggaagatgagcatgactacgcagatgcatgccaggcatcagaggcagaagcgctaccggtggccctaaaacagtatgcagactcccacaccacccccaaccttcctccaccttcccagaagccaagtttcctgggggaaaatgaaactctgcctctttccatactagctctgacatctgttgctattttggccgctctgctggtgcttctatgctctatatgctacctgatctgctgcagaaagaaaaaatctcacggccatgctcaccagcccctcatgcacttcccttaccctccagagctgggcgaccacaaactttaagtctgcagtagctatctgcccatcccttgtcagtcgacagcgatgagccccactaatctaacagcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggcccttcgtcatcacacctgaagataatgatgatgatgacaccacctccaggctgcagagcctaaagcagctactcttctcttttacagcatggtaaattgaatcatgccccgcattttcatctacttgcttctccttccactttttctgggctcctctacattggccactgtgtcccacatcgaggtagactgcctcacgcccttcacagtctacctgcttttcggctttgtcatctgcacctttgtctgcagcgttatcactgtagtgatctgcttcatacagtgcatcgactacatctgtgtgcgggtggcctactttagacaccacccccagtatcgcaacagggacatagcggctctcctaagacttgtttaaatcatggccaaattacctgtgattggtcttctgattatctgctgcgtcctagccgcgattgggactcaacctaataccaccaccagcgctcccagaaagagacatgtatcctgcagcttcaagcgtccctggaatataccccaatgctttactgatgaacctgaaatctctttggcttggtacttcagcgtcaccgcccttctcatcttctgcagtacggttattgctcttgccatctacccttcccttaacctgggctggaatgctgtcaactctatggaatatcccaccttcccagaaccagacctgccagacctggttgttctaaacgcgtttcctcctcctccagttcaaaatcagtttcgccctccgtcccctacgcccactgaggtcagctactttaatctaacaggcggagatgactgaaaacctagacctagaaatggacggtctctgcagcgagcaacgcacactagagaggcgccggcaaaaagcagagctcgagcgtcttaaacaagagctccaagacgccgtggccatacaccagtgcaaaaaagggctcttctgtctggtaaaacaggccacgctcacctatgaaaaaacaggtgacacccaccgcctaggatacaagctgcccacacagcgccaaaagtttgcccttatgataggtgaacaacccatcaccgtcacccagcactccgtggagacagaaggctgcattcatgctccctgcaggggcgctgactgcctctacaccttgatcaaaaccctctgcggtctcagagaccttatccctttcaattgatcataactgtaatcaataaaaaatcacttacttgaaatctgatagcaagactctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttacagatgaaacgcgcgagatcgtctgacgagaccttcaaccccgtgtacccctacgataccgagatcgctccgacttctgtccctttccttacccctccctttgtatcatccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagagcctcccctgcatgcaagtgacagcagtagcctgggccttagcgtcacggccccacttagcattaacaatgacagcctaggactagacatgcaagcgcccatcagctctcgagatggaaaactggctctaacagtggcggcccccctaactgtggccgagggtatcaatgctttggcagtagccacaggtaatggtattggactaaatgaaaccaacacacacctgcaggcaaaactggtcgcgcccctaggctttgataccaacggcaacattaagctaagcgtcgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatgtaacatcttctaacaaccaaaacggtctagaggccaacattaaactaacaaaaggccttgtgtatgacggaaatgccatagcagttaatgttggcaaagggctggaatacagccctactggcacaacagaaaaacctatacagactaaaataggtctaggcatggagtatgacactgagggagccatgatgacaaaactaggctctggactaagctttgacaattcaggagccattgtggtgggaaacaaaaatgatgacaggcttactttgtggaccacaccggacccatcgcccaactgtcagatttactctgaaaaagatgctaaactaaccttggtactgactaaatgtggcagtcaggttgtaggcacagtatctattgccgctcttaaaggtagccttgtgccaatcactagtgcaatcagtgtggttcagatatacctaaggtttgatgaaaatggggtgctgatgagtaactcttcacttaatggcgaatactggaattttagaaacggagactcaactaatggcacaccatatacaaacgcagtgggttttatgcctaatctactggcctatcctaaaggtcaaactacaactgcaaaaagtaacattgtcagccaggtctacatgaacggggacgatactaaacccatgacatttacaatcaacttcaatggccttagtgaaacaggggatacccctgtcagtaaatattccatgacattctcatggaggtggccaaatggaagctacatagggcacaattttgtaacaaactcctttactttctcctacatcgcccaagaataaagaaagcacagagatgcttgtttttgatttcaaaattgtgtgcttttatttattttcaagcttacagtatttccagtagtcattagaatagagcttaattaaactgcatgagaacccttccacatagcttaaattatcaccagtgcaaatggaaaaaaatcaacatacctttttatccagatatcaaagaactctagtggtcagttttcccccaccctcccagctcacagaatacacagtcctttccccccggctggctttaaacaacactatctcattggtaacagacatatttttaggtgtaataatccacacggtctcttggcgggccaaacgctggtctgtgatgttaataaactccccaggcagctctttcaagttcacgtcgctgtccaactgctgaagcgctcgcggctccgactgcgcctctagcggaggcaacggcagcacccgatccttgatctataaaggagtagagtcataatcccccataagaatagggcggtgatgcagcaacaaggcgcgcagcaactcctgccgccgcctctccgtacgacaggaatgcaacggggtggtggtctcctccgcgataatccgcaccgctcgcagcatcagcatcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcgtaccagatcctcaggtaaatcaaatgacgacctctcataaacacgctggacatatacatcacctccttgggcatgagctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaagaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccacgaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacaatgggatagactactctaaccaacataagacgggccacgacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatacagcgcttccacagcagccatgacaaaagactcaaaacactcaaaagactcagtcttaccaggaaaataaaagcactctcacagcaccagcactaatcagagtgtgaagagggccaagtgccgaacgagtatatataggaattaaaaatgacgtaaatgtgtaaaggtcaaaaaacgcccagaaaaatacacagaccaacgcccgaaacgaaaacccgcgaaaaaatacccagaagttcctcaacaaccgccacttccgctttcccacgatacgtcacttcctcaaaaatagcaaactacatttcccacatgtacaaaaccaaaacccctccccttgtcaccgcccacaacttacataatcacaaacgtcaaagcctacgtcacccgccccgcctcgccccgcccacctcattatcatattggcctcaatccaaaataaggtatattattgatgatg

SEQ ID NO: 1220 - DNA, 15 bp, Artificial Sequence
  synthetic
cgcgacttcgccgcc

The invention claimed is:

1. A collection of one or more expression vectors each comprising all or part of a collection of nucleic acids encoding a cancer vaccine peptide collection (CVP) comprising the 209 frame-shift peptides (FSPs) and modified FSPs (mFSPs) according to SEQ ID NO: 1 to 209, wherein the entirety of the collection of expression vectors comprise all of the collection of nucleic acids.

2. The collection of expression vectors of claim 1 wherein at least one of the expression vector comprises one or more elements that enhance immunogenicity of the expression vector.

3. The collection of expression vectors of claim 1, wherein at least one of the expression vectors comprises one or more nucleic acids encoding an element that enhances immunogenicity of the CVP selected from the group consisting of an invariant chain sequence or fragment thereof, a signal peptide of human tissue-type plasminogen activator, a PEST sequence, a cyclin destruction box, an ubiquitination signal, a SUMOylation signal, an Interleukin, and a checkpoint protein specific ligand.

4. The collection of expression vectors of claim 1, wherein each expression vector is selected from the group consisting of a plasmid; a cosmid, an RNA, an RNA formulated with an adjuvant, an RNA formulated in liposomal particles, a self-amplifying RNA (SAM), a SAM formulated with an adjuvant, a SAM formulated in liposomal particles, and a viral vector.

5. The collection of expression vectors of claim 1, wherein the peptides of the CVP are separate or at least two are comprised in one or more polypeptides.

6. The collection of expression vectors of claim 1, wherein the CVP consists of or comprises the four polypeptides with amino acid sequences according to SEQ ID NO: 1088 to 1091 (layout A), SEQ ID NO: 1092 to 1095 (layout B), SEQ ID NO: 1155 to 1158 (layout C) or SEQ ID NO: 1159 to 1162 (layout D).

7. A collection of nucleic acids encoding a cancer vaccine peptide collection (CVP) comprising the 209 frame-shift peptides (FSPs) and modified FSPs (mFSPs) according to SEQ ID NO: 1 to 209.

8. A method of producing a CVP comprising the steps of
(i) obtaining the collection of one or more expression vectors of claim 1; and
(ii) recombinantly expressing the amino acid sequence of the CVP in one or more polypeptides.

* * * * *